US011732260B2

(12) United States Patent
Rigo et al.

(10) Patent No.: US 11,732,260 B2
(45) Date of Patent: Aug. 22, 2023

(54) COMPOUNDS AND METHODS FOR THE MODULATION OF AMYLOID-β PRECURSOR PROTEIN

(71) Applicants: Ionis Pharmaceuticals, Inc., Carlsbad, CA (US); Rosalind Franklin University of Medicine and Science, North Chicago, IL (US)

(72) Inventors: Frank Rigo, Carlsbad, CA (US); Michelle L. Hastings, North Chicago, IL (US)

(73) Assignees: Ionis Pharmaceuticals, Inc., Carlsbad, CA (US); Rosalind Franklin University of Medicine and Science, North Chicago, IL (US)

( * ) Notice: Subject to any disclaimer, the term of this patent is extended or adjusted under 35 U.S.C. 154(b) by 0 days.

(21) Appl. No.: 16/977,649

(22) PCT Filed: Mar. 1, 2019

(86) PCT No.: PCT/US2019/020246
§ 371 (c)(1),
(2) Date: Sep. 2, 2020

(87) PCT Pub. No.: WO2019/169243
PCT Pub. Date: Sep. 6, 2019

(65) Prior Publication Data
US 2021/0040480 A1 Feb. 11, 2021

Related U.S. Application Data

(60) Provisional application No. 62/637,809, filed on Mar. 2, 2018.

(51) Int. Cl.
*C07H 21/04* (2006.01)
*C12N 15/113* (2010.01)

(52) U.S. Cl.
CPC ........ *C12N 15/113* (2013.01); *C12N 2310/11* (2013.01); *C12N 2310/315* (2013.01); *C12N 2310/32* (2013.01); *C12N 2310/3231* (2013.01); *C12N 2310/3233* (2013.01); *C12N 2310/346* (2013.01); *C12N 2320/33* (2013.01)

(58) Field of Classification Search
None
See application file for complete search history.

(56) References Cited

U.S. PATENT DOCUMENTS

| | | |
|---|---|---|
| 3,687,808 A | 8/1972 | Merigan et al. |
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,286,717 A | 2/1994 | Cohen et al. |
| 5,319,080 A | 6/1994 | Leumann |
| 5,321,131 A | 6/1994 | Agrawal et al. |

(Continued)

FOREIGN PATENT DOCUMENTS

| | | |
|---|---|---|
| EP | 2601294 | 11/2018 |
| WO | WO 1989/006693 | 7/1989 |

(Continued)

OTHER PUBLICATIONS

Hua, Yimin, et al. ("Enhancement of SMN2 exon 7 inclusion by antisense oligonucleotides targeting the exon." PLoS biology 5.4 (2007).*

Nikiforov et al. (PCR Methods and Applications, 1994, vol. 3: 285-291.*

Allinquant et al., "Downregulation of amyloid precursor protein inhibits neurite outgrowth in vitro" J Cell Biol (1995) 128:919-927.

Ali et al., "Nitric oxide activity and isoenzyme expression in the senescence-accelerated mouse p8 model of Alzheimer's disease: effects of anti-amyloid antibody and antisense treatments" J Gerontol A Biol Sci Med Sci (2009) 64: 1025-1030.

Armbrecht et al., "Antisense against Amyloid-β Protein Precursor Reverses Memory Deficits and Alters Gene Expression in Neurotropic and Insulin-Signaling Pathways in SAMP8 Mice" J Alzheimers Dis (2015) 46: 535-548.

(Continued)

*Primary Examiner* — Kimberly Chong
(74) *Attorney, Agent, or Firm* — McNeill Baur PLLC

(57) ABSTRACT

Certain embodiments disclosed herein are directed to compounds and methods for modulating APP expression. In certain embodiments, modulating the splicing of amyloid precursor protein (APP) reduces amyloid β (Aβ) production.

39 Claims, No Drawings
Specification includes a Sequence Listing.

(56) References Cited

U.S. PATENT DOCUMENTS

| | | |
|---|---|---|
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,670,634 A | 9/1997 | Marotta et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,837,449 A * | 11/1998 | Monia ................ C07K 14/4711 435/6.16 |
| 5,859,221 A | 1/1999 | Cook et al. |
| 5,912,410 A * | 6/1999 | Cordell ............... C12N 15/8509 800/12 |
| 5,948,903 A | 9/1999 | Cook et al. |
| 5,994,517 A | 11/1999 | Ts'O |
| 6,005,087 A | 12/1999 | Cook et al. |
| 6,005,096 A | 12/1999 | Matteucci et al. |
| 6,166,199 A | 12/2000 | Cook et al. |
| 6,177,246 B1 | 1/2001 | Monia et al. |
| 6,300,319 B1 | 10/2001 | Manoharan |
| 6,310,048 B1 * | 10/2001 | Kumar ................ C07K 14/4711 435/375 |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,699,671 B1 | 3/2004 | Gurney et al. |
| 6,770,748 B2 | 8/2004 | Imanishi et al. |
| 7,015,315 B1 | 3/2006 | Cook et al. |
| 7,053,207 B2 | 5/2006 | Wengel et al. |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,635,771 B2 | 12/2009 | Khvorova et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,829,696 B2 | 11/2010 | Khvorova et al. |
| 7,875,733 B2 | 1/2011 | Bhat et al. |
| 7,939,677 B2 | 5/2011 | Bhat et al. |
| 8,022,193 B2 | 9/2011 | Swayze et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,268,980 B2 | 9/2012 | Seth et al. |
| 8,268,985 B2 | 9/2012 | Khvorova et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,283,517 B2 * | 10/2012 | Schilling ........ C12Y 203/02005 435/325 |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,658,784 B2 | 2/2014 | Khvorova et al. |
| 8,673,560 B2 * | 3/2014 | Leamon ................ C12Q 1/6886 536/23.1 |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |

(56) References Cited

U.S. PATENT DOCUMENTS

| | | | |
|---|---|---|---|
| 9,290,760 | B2 | 3/2016 | Rajeev et al. |
| 10,364,432 | B2* | 7/2019 | Van Roon-Mom ..... A61P 21/00 |
| 10,900,041 | B2* | 1/2021 | De Vlaam ........... A61K 31/713 |
| 2001/0053519 | A1 | 12/2001 | Fodor et al. |
| 2003/0158403 | A1 | 8/2003 | Manoharan et al. |
| 2003/0175906 | A1 | 9/2003 | Manoharan et al. |
| 2003/0221204 | A1* | 11/2003 | Golde ................ C07K 14/4711 435/325 |
| 2003/0228597 | A1 | 12/2003 | Cowsert et al. |
| 2003/0232435 | A1* | 12/2003 | Dobie ................. C12N 15/113 435/375 |
| 2004/0171570 | A1 | 9/2004 | Allerson et al. |
| 2005/0043264 | A1* | 2/2005 | Juang ................... A61K 38/005 514/17.8 |
| 2005/0130923 | A1 | 6/2005 | Bhat et al. |
| 2005/0209179 | A1* | 9/2005 | McSwiggen ... C12Y 207/07049 536/23.1 |
| 2006/0148740 | A1 | 7/2006 | Platenburg |
| 2006/0172964 | A1 | 8/2006 | Tanzi et al. |
| 2006/0247194 | A1* | 11/2006 | McSwiggen ......... C12N 15/113 536/23.1 |
| 2007/0031844 | A1 | 2/2007 | Khvorova et al. |
| 2007/0032443 | A1 | 2/2007 | Kim et al. |
| 2008/0039618 | A1 | 2/2008 | Allerson et al. |
| 2009/0023158 | A1* | 1/2009 | Shapiro .................... C12Q 1/37 435/7.1 |
| 2010/0190807 | A1 | 7/2010 | Porter et al. |
| 2010/0190837 | A1 | 7/2010 | Migawa et al. |
| 2010/0197762 | A1 | 8/2010 | Swayze et al. |
| 2011/0166197 | A1 | 7/2011 | Darling et al. |
| 2013/0130378 | A1 | 5/2013 | Manoharan et al. |
| 2014/0107330 | A1 | 4/2014 | Freier et al. |
| 2015/0018540 | A1 | 1/2015 | Prakash et al. |
| 2015/0184153 | A1 | 7/2015 | Freier et al. |
| 2015/0191727 | A1 | 7/2015 | Migawa et al. |
| 2015/0267195 | A1 | 9/2015 | Seth et al. |
| 2015/0275212 | A1 | 10/2015 | Albaek et al. |
| 2016/0186175 | A1 | 6/2016 | Seth et al. |
| 2016/0238606 | A1 | 8/2016 | McNeel et al. |
| 2017/0044526 | A1 | 2/2017 | Wan et al. |

FOREIGN PATENT DOCUMENTS

| | | |
|---|---|---|
| WO | 1993013114 A1 | 7/1993 |
| WO | 1995009236 A1 | 4/1995 |
| WO | WO 2001/042266 | 6/2001 |
| WO | WO 2001/050829 | 7/2001 |
| WO | 2004045543 A2 | 6/2004 |
| WO | WO 2005/003350 | 1/2005 |
| WO | WO 2005/042777 | 5/2005 |
| WO | WO 2005/116204 | 12/2005 |
| WO | WO 2009/105572 | 8/2009 |
| WO | WO 2012/018257 | 2/2012 |
| WO | 2013173635 A1 | 11/2013 |
| WO | 2013173637 A1 | 11/2013 |
| WO | WO 2014/144942 | 9/2014 |
| WO | 2015053624 A2 | 4/2015 |
| WO | WO 2017/064308 | 4/2017 |
| WO | WO 2019/037133 | 2/2019 |
| WO | 2019143978 A1 | 7/2019 |
| WO | 2019162692 A1 | 8/2019 |
| WO | WO 2019/169243 | 9/2019 |
| WO | 2020006267 A1 | 1/2020 |
| WO | 2020124257 A1 | 6/2020 |
| WO | WO 2020/132227 | 6/2020 |
| WO | WO 2020/160163 | 8/2020 |
| WO | 2020257194 A1 | 12/2020 |
| WO | 2022026589 A1 | 2/2022 |

OTHER PUBLICATIONS

Banks et al., "Delivery across the blood-brain barrier of antisense directed against amyloid beta: reversal of learning and memory deficits in mice overexpressing amyloid precursor protein" J Pharmacol Exp Ther (2001) 297: 1113-1121.
Branch et al., "A good antisense molecule is hard to find," TIBS (1998) 23:45-50.
Chang et al., "Targeting Amyloid-β Precursor Protein, APP, Splicing with Antisense Oligonucleotides Reduces Toxic Amyloid-β Production" Mol Ther (2018) 26: 1539-1551.
Chang et al., "Inhibition of the NGF and IL-lbeta-induced expression of Alzheimer's amyloid precursor protein by antisense oligonucleotides" J Mol Neurosci (1999) 12: 69-74.
Chauhan et al., "Antisense inhibition at the beta-secretase-site of beta-amyloid precursor protein reduces cerebral amyloid and acetyl cholinesterase activity in Tg2576" Neuroscience (2007) 146: 143-151.
Chauhan "Trafficking of intracerebroveiitricularly injected antisense oligonucleotides in the mouse brain" Antisense Nucleic Acid Drug Dev (2002) 12: 353-357.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Coulson et al., "Down-regulation of the amyloid protein precursor of Alzheimer's disease by antisense oligonucleotides reduces neuronal adhesion to specific substrata" Brain Res (1997) 770: 72-80.
Crooke et al., "Basic Principles of Antisense Therapeutics" Antisense Research and Application (1998) Chapter 1:1-50.
Crooke, ST., et al., "Antisense Drug Technology" Second Edition, CRC Press (2008) Chapters 1-28.
Currie et al., "Reduction of histone cytotoxicity by the Alzheimer beta-amyloid peptide precursor" Biochim Biophys Acta (1997) 1355: 248-258.
Dawson et al., "Age-related cognitive deficits, impaired long-term potentiation and reduction in synaptic marker density in mice lacking the beta-amyloid precursor protein" Neuroscience (1999) 90: 1-13.
Denman et al., "Facilitator oligonucleotides increase ribozyme RNA binding to full-length RNA substrates in vitro" FEBS Lett (1996) 382: 116-120.
Denman et al. "Hairpin ribozyme specificity in vivo: a case of promiscuous cleavage" Biochem Biophys Res Common (1999) 257: 356-360.
Denman et al., "Differential activity of trans-acting hammerhead ribozymes targeted to beta amyloid peptide precursor mRNA by altering the symmetry of helices I and III" Arch Biochem Biophys (1995) 323: 71-78.
Denman et al. "Facilitated reduction of beta-amyloid peptide precursor by synthetic oligonucleotides in COS-7 cells expressing a hammerhead ribozyme" Arch Biochem Biophys (1997) 348: 82-90.
Dewachter et al., "Modeling Alzheimer's disease in transgenic mice: effect of age and of presenilin1 on amyloid biochemistry and pathology in APP/London mice" Exp Gerontol (2000) 35: 831-841.
Dingwall "Spotlight on BACE: the secretases as targets for treatment in Alzheimer disease" J Clin Invest (2001) 108: 1243-1246.
Dolzhanskaya et al., "In vivo ribozyme targeting of betaAPP+ mRNAs" Mol Cell Biol Res Commun (2000) 4: 239-247.
Dolzhanskaya et al., "Self-cleaving-ribozyme-mediated reduction of betaAPP in human rhabdomyosarcoma cells" Arch Biochem Biophys (2001) 387: 223-232.
Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41): 16642-16649.
Erickson et al., "Inflammation-induced dysfunction of the low-density lipoprotein receptor-related protein-1 at the blood-brain barrier: protection by the antioxidant N-acetylcysteine" Brain Behav Immun (2012) 26: 1085-1094.
Farr et al., "Central and peripheral administration of antisense oligonucleotide targeting amyloid-β protein precursor improves learning and memory and reduces neuroinflammatory cytokines in Tg2576 (AβPPswe) mice" J Alzheimers Dis (2014) 40: 1005-1016.

(56) References Cited

OTHER PUBLICATIONS

Feng et al., "Allele-specific silencing of Alzheimer's disease genes: the amyloid precursor protein genes with Swedish or London mutations" Gene (2006) 371: 68-74.
Gautschi et al., "Activity of a novel bcl-2/bcl-xLbispecific antisense oligonucleotide against tumors of diverse histologic origins" J. Natl. Cancer Inst. (2001) 93:463-471.
Harper et al., "Mouse cortical neurones lacking APP show normal neurite outgrowth and survival responses in vitro" Neuroreport (1998) 9: 3053-3058.
Hoffmann et al., "A possible role for the Alzheimer amyloid precursor protein in the regulation of epidermal basal cell proliferation" Eur J Cell Biol (2000) 79: 905-914.
International Search Report for PCT/US19/020246 dated May 10, 2019.
International Search Report for PCT/US20/015701 dated Jun. 23, 2020.
Kibbey et al., "beta-Amyloid precursor protein binds to the neurite-promoting IKVAV site of laminin" Proc Natl Acad Sci (1993) 90: 10150-10153.
Kienlen-Campard et al., "The processing and biological function of the human amyloid precursor protein (APP): lessons from different cellular models" Exp Gerontol (2000) 35: 843-850.
Konig et al., "Identification and differential expression of a novel alternative splice isoform of the beta A4 amyloid precursor protein (APP) mRNA in leukocytes and brain microglial cells" J Biol Chem (1992) 267: 1992.
Kumar et al., "Molecular cloning, expression, and regulation of hippocampal amyloid precursor protein of senescence accelerated mouse (SAMP8)" Biochem Cell Biol (2001) 79: 57-67.
Kumar et al., "Site-directed antisense oligonucleotide decreases the expression of amyloid precursor protein and reverses deficits in learning and memory in aged SAMP8 mice" Peptides (2000) 21: 1769-1775.
Le et al., "beta-Amyloidl-40 increases expression of beta-amyloid precursor protein in neuronal hybrid cells" J Neurochem (1995) 65: 2373-2376.
Le et al., "Beta-amyloid-induced neurotoxicity of a hybrid septal cell line associated with increased tau phosphorylation and expression of beta-amyloid precursor protein" J Neurochem (1997) 69: 978-985.
Leblanc et al., "Role of amyloid precursor protein (APP): study with antisense transfection of human neuroblastoma cells" J Neurosci Res (1992) 31: 635-645.
Li et al., "Polymorphic tetranucleotide repeat site within intron 7 of the beta-amyloid precursor protein gene and its lack of association with Alzheimer's disease" Hum Genet (1998) 103: 86-89.
Luo et al., "Characterization of the neurotrophic interaction between nerve growth factor and secreted alpha-amyloid precursor protein" J Neurosci Res (2001) 63: 410-420.
Luo et al., "Death of PC12 cells and hippocampal neurons induced by adenoviral-mediated FAD human amyloid precursor protein gene expression" J Neurosci Res (1999) 55: 629-642.
Magner et al., "Influence of mismatched and bulged nucleotides on SNP-preferential RNase H cleavage of RNA-antisense gapmer heteroduplexes" Sci Rep (2017) 7:12532 1-16.
Maher et al., "Comparative hybrid arrest by tandem antisense oligodeoxy ribonucleotides or oligodeoxyribonucleoside methylpbosphonates in a cell-free system" Nucl. Acid. Res. (1988) 16(8):3341-3358.
Majocha et al. "Modulation of the PC12 cell response to nerve growth factor by antisense oligonucleotide to amyloid precursor protein" Cell Mol NeuroBiol (1994) 14: 425-437.
Manczak et al., "RNA silencing of genes involved in Alzheimer's disease enhances mitochondrial function and synaptic activity" Biochim Biophys Acta (2013) 1832: 2368-2378.
Meng et al., "Amyloid beta protein precursor is involved in the growth of human colon carcinoma cell in vitro and in vivo" Int J Cancer (2001) 92: 31-39.

Miller et al., "Targeting Alzheimer's disease genes with RNA interference: an efficient strategy for silencing mutant alleles" Nucleic Acids Res (2004) 32: 661-668.
New England Biolabs 1998/99 Catalog (cover page and pp. 121 and 284).
Ohnishi et al., "Assessment of allele-specific gene silencing by RNA interference with mutant and wild-type reporter alleles" J RNAi Gene Silencing (2006) 2: 154-160.
Pietrzik et al., "From differentiation to proliferation: the secretory amyloid precursor protein as a local mediator of growth in thyroid epithelial cells" Proc Natl Acad Sci USA (1998) 95: 1770-1775.
Poon et al., "Antisense directed at the Abeta region of APP decreases brain oxidative markers in aged senescence accelerated mice" Brain Res. (2004) 1018: 86-96.
Poon et al., "Proteomic identification of less oxidized brain proteins in aged senescence-accelerated mice following administration of antisense oligonucleotide directed at the Abeta region of amyloid precursor protein" Brain Res Mol Brain Res (2005) 138: 8-16.
Reynolds et al., "Rational siRNA design for RNA interference" Nature Biotechnology (2004) 22(3):326-330.
Saitoh et al., "Secreted form of amyloid beta protein precursor is involved in the growth regulation of fibroblasts" Cell (1989) 58: 615-622.
Sandbrink et al., "APP gene family: unique age-associated changes in splicing of Alzheimer's betaA4-amyloid protein precursor" Neurobiol Dis (1994) 1: 13-24.
Sanghvi et al., "Heterocyclic Base Modifications in Nucleic Acids and Their Applications in Antisense Oligonucleotides" Antisense Research and Applications (1993) pp. 273-288.
Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.
Suh et al., "Molecular physiology, biochemistry, and pharmacology of Alzheimer's amyloid precursor protein (APP)" Ann NY Acad Sci (1996) 786: 169-183.
Woolf et al., "Specificity of antisense oligonucleotides in vivo" PNAS (1992) 89: 7305-7309.
Yoshikai et al., "Genomic organization of the human amyloid beta-protein precursor gene" Gene (1990) 87: 257-263.
Sawa et al., "APP-directed antisense oligonucleotides reduced APP gene expression in mouse models of Down Syndrome" Poster Presentation for Society ofNeuroscience (2018) Nov. 3-7, 2018 San Diego, CA.
Sawa et al., "APP-directed antisense oligonucleotides reduced APP gene expression in mouse models of Down Syndrome" Abstract for Society of Neuroscience (2018) Nov. 3-7, 2018 San Diego, CA.
Bernstein et al., "Role for a bidentate ribonuclease in the initiation step of RNA interference" Nature (2001) 409: 363-366.
Elbashir et al., "RNA interference is mediated by 21- and 22-nucleotide RNAs" Genes Dev (2001) 15:188-200.
Extended EP Search Report for 19760045.5 dated Feb. 28, 2022, 7 pages.
International Search Report for PCT/US21/043520 dated Jan. 5, 2022, 14 pages.
Lima et al., "Single-stranded siRNAs activate RNAi in animals" Cell (2012) 150: 883-894.
Nhan et al., "The multifaceted nature of amyloid precursor protein and its proteolytic fragments: friends and foes" Acta Neuropathol (2015) 129: 1-19.
Nykanen et al., "ATP requirements and small interfering RNA structure in the RNA interference pathway" Cell (2001) 107: 309-321.
Ostergaard et al., "Understanding the effect of controlling phosphorothioate chirality in the DNA gap on the potency and safety of gapmer antisense oligonucleotides" Nucleic Acids Res (2020) 48: 1691-1700.
Sharp "RNA interference—2001" Genes Dev (2001) 15: 485-490.
Grabowska-Pyrzewicz et al., "Antisense oligonucleotides for Alzheimer's disease therapy: from the mRNA to miRNA paradigm" EBioMedicine (2021) 74(103691): 1-10.

(56) References Cited

OTHER PUBLICATIONS

Nguyen, "β-Amyloid precursor protein (APP) and the human diseases" AIMS Neurosci (2019) 6(4): 273-281.
Stein et al., "Beta-amyloid deposition in chronic traumatic encephalopathy" Acta Neuropathol (2015) 130(1): 21-34.

* cited by examiner

COMPOUNDS AND METHODS FOR THE MODULATION OF AMYLOID-β PRECURSOR PROTEIN

SEQUENCE LISTING

The present application is being filed along with a Sequence Listing in electronic format. The Sequence Listing is provided as a file entitled BIOL0333USASEQ_ST25.txt created on Aug. 18, 2020 which is approximately 680 KB in size. The information in the electronic format of the sequence listing is incorporated herein by reference in its entirety.

FIELD

Certain embodiments disclosed herein are directed to compounds and methods for modulating APP expression. In certain embodiments, modulating the splicing of amyloid precursor protein (APP) reduces amyloid β (Aβ) production.

BACKGROUND

Alzheimer's disease (AD) is the most prevalent neurodegenerative disorder, accounting for 60-80% of the more than 40 million cases of dementia worldwide. One pathological hallmark of AD is the accumulation of amyloid β (Aβ) peptide as extracellular plaques in the brain. Aβ is a 38-42 amino acid peptide that is produced by proteolysis of amyloid precursor protein, APP. Some forms of Aβ are prone to aggregation and plaque formation, which is thought to initiate a cascade of pathological events associated with the development and progression of AD. Thus, targeting Aβ has been a major focus of therapeutic development for AD.

Antisense technology is an effective means for modulating the expression of one or more specific gene products, including alternative splice products, and is uniquely useful in a number of therapeutic, diagnostic, and research applications. The principle behind antisense technology is that an antisense compound, which hybridizes to a target nucleic acid, modulates gene expression activities such as transcription, splicing or translation through one of a number of antisense mechanisms. The sequence specificity of antisense compounds makes them extremely attractive as tools for target validation and gene functionalization, as well as therapeutics to selectively modulate the expression of genes involved in disease.

SUMMARY

Amyloid precursor protein (APP) is an integral membrane protein that is the precursor protein for beta amyloid (Aβ). Proteolytic cleavage of APP generates Aβ, and Aβ is the primary component of senile plaques associated with Alzheimer's Disease. In certain embodiments, APP contains several proteolytic cleavage sites that, when cleaved by a protease (for example γ-secretase) produce Aβ. APP cleavage can also produce Aβ42, a longer form of Aβ that is more prone to aggregation and is associated with neurotoxic amyloid formation. Accordingly, reducing Aβ production or preventing Aβ formation from APP can delay or prevent the formation of senile plaques caused by aggregation of Aβ. Also, reducing Aβ42 production or preventing Aβ42 formation from APP can delay or prevent the formation of senile plaques caused by aggregation of Aβ42.

The present disclosure provides compounds and methods for reducing Aβ expression. In certain embodiments, modified oligonucleotides targeted to the APP transcript modulates splicing of APP in a manner that prevents the formation of Aβ. In certain embodiments, modified oligonucleotides targeted to the APP transcript modulates splicing of APP in a manner that prevents the formation of Aβ42. For example, the present disclosure provides modified oligonucleotides targeted to APP that block exon 17 splicing. Surprisingly, blocking exon 17 splicing induces the production of an alternatively spliced APP mRNA isoform that lacks 49 amino acids. These 49 amino acids include the γ-secretase cleavage sites on APP that, when cleaved, give rise to toxic Alzheimer's Disease associated Aβ, including Aβ42.

In certain embodiments, modified oligonucleotides disclosed herein reduce the inclusion of exon 17 in APP mRNA. In certain embodiments, modified oligonucleotides disclosed herein reduce the amount of Aβ. In certain embodiments, modified oligonucleotides disclosed herein prevent the formation of Aβ. In certain embodiments, modified oligonucleotides disclosed herein reduce the amount of Aβ42. In certain embodiments, modified oligonucleotides disclosed herein prevent the formation of Aβ42.

DETAILED DESCRIPTION

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference for the portions of the document discussed herein, as well as in their entirety.

It is understood that the sequence set forth in each SEQ ID NO described herein is independent of any modification to a sugar moiety, an internucleoside linkage, or a nucleobase. As such, antisense compounds defined by a SEQ ID NO may comprise, independently, one or more modifications to a sugar moiety, an internucleoside linkage, or a nucleobase. Antisense compounds described by Compound Number (Compound No) indicate a combination of nucleobase sequence and motif.

Unless specific definitions are provided, the nomenclature used in connection with, and the procedures and techniques of, analytical chemistry, synthetic organic chemistry, and medicinal and pharmaceutical chemistry described herein are those well known and commonly used in the art. Standard techniques may be used for chemical synthesis and chemical analysis. Certain such techniques and procedures may be found for example in "Carbohydrate Modifications in Antisense Research" Edited by Sangvi and Cook, American Chemical Society, Washington D.C., 1994; "Remington's Pharmaceutical Sciences," Mack Publishing Co., Easton, Pa., 21$^{st}$ edition, 2005; and "Antisense Drug Technology, Principles, Strategies, and Applications" Edited by Stanley T. Crooke, CRC Press, Boca Raton, Fla.; and Sambrook et al., "Molecular Cloning, A laboratory Manual," 2nd Edition, Cold Spring Harbor Laboratory Press, 1989, which are hereby incorporated by reference for any purpose. Where permitted, all patents, applications, published applications and other publications and other data referred to throughout in the disclosure are incorporated by reference herein in their entirety.

Unless otherwise indicated, the following terms have the following meanings:

As used herein, "APP" means amyloid beta precursor protein or the nucleic acid that encodes amyloid beta precursor protein. In certain embodiments, the APP transcript comprises GENBANK NC_000021.9, truncated from 25878001 to 26174000 (SEQ ID NO: 1).

As used herein, "amyloid beta precursor protein" or "APP" means any APP nucleic acid or protein. "APP nucleic acid" or "APP transcript" means any nucleic acid encoding APP. For example, in certain embodiments, an APP nucleic acid includes a DNA sequence encoding APP, an RNA sequence transcribed from DNA encoding APP, including a non-protein encoding (i.e. non-coding) RNA sequence, and an mRNA sequence encoding APP. "APP mRNA" means an mRNA encoding an APP protein.

As used herein, "nucleoside" means a compound comprising a nucleobase moiety and a sugar moiety. Nucleosides include, but are not limited to, naturally occurring nucleosides (as found in DNA and RNA) and modified nucleosides. Nucleosides may be linked to a phosphate moiety.

As used herein, "chemical modification" means a chemical difference in a compound when compared to a naturally occurring counterpart. In reference to an oligonucleotide, chemical modification does not include differences only in nucleobase sequence. Chemical modifications of oligonucleotides include nucleoside modifications (including sugar moiety modifications and nucleobase modifications) and internucleoside linkage modifications.

As used herein, "furanosyl" means a structure comprising a 5-membered ring comprising four carbon atoms and one oxygen atom.

As used herein, "naturally occurring sugar moiety" means a ribofuranosyl as found in naturally occurring RNA or a deoxyribofuranosyl as found in naturally occurring DNA.

As used herein, "sugar moiety" means a naturally occurring sugar moiety or a modified sugar moiety of a nucleoside.

As used herein, "modified sugar moiety" means a substituted sugar moiety, a bicyclic or tricyclic sugar moiety, or a sugar surrogate.

As used herein, "substituted sugar moiety" means a furanosyl comprising at least one substituent group that differs from that of a naturally occurring sugar moiety. Substituted sugar moieties include, but are not limited to, furanosyls comprising substituents at the 2'-position, the 3'-position, the 5'-position and/or the 4'-position.

As used herein, "2'-substituted sugar moiety" means a furanosyl comprising a substituent at the 2'-position other than H or OH. Unless otherwise indicated, a 2'-substituted sugar moiety is not a bicyclic sugar moiety (i.e., the 2'-substituent of a 2'-substituted sugar moiety does not form a bridge to another atom of the furanosyl ring.

As used herein, "MOE" means —OCH$_2$CH$_2$OCH$_3$.

As used herein, "bicyclic sugar moiety" means a modified sugar moiety comprising a 4 to 7 membered ring (including but not limited to a furanosyl) comprising a bridge connecting two atoms of the 4 to 7 membered ring to form a second ring, resulting in a bicyclic structure. In certain embodiments, the 4 to 7 membered ring is a sugar ring. In certain embodiments the 4 to 7 membered ring is a furanosyl. In certain such embodiments, the bridge connects the 2'-carbon and the 4'-carbon of the furanosyl.

As used herein the term "sugar surrogate" means a structure that does not comprise a furanosyl and that is capable of replacing the naturally occurring sugar moiety of a nucleoside, such that the resulting nucleoside is capable of (1) incorporation into an oligonucleotide and (2) hybridization to a complementary nucleoside. Such structures include rings comprising a different number of atoms than furanosyl (e.g., 4, 6, or 7-membered rings); replacement of the oxygen of a furanosyl with a non-oxygen atom (e.g., carbon, sulfur, or nitrogen); or both a change in the number of atoms and a replacement of the oxygen. Such structures may also comprise substitutions corresponding to those described for substituted sugar moieties (e.g., 6-membered carbocyclic bicyclic sugar surrogates optionally comprising additional substituents). Sugar surrogates also include more complex sugar replacements (e.g., the non-ring systems of peptide nucleic acid). Sugar surrogates include without limitation morpholino, modified morpholinos, cyclohexenyls and cyclohexitols.

As used herein, "phosphordiamidite morpholiono oligomer" or "PMO" means an oligomer comprising subunits having the following structure:

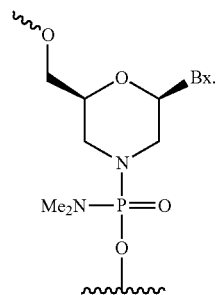

As used herein, "nucleotide" means a nucleoside further comprising a phosphate linking group. As used herein, "linked nucleosides" may or may not be linked by phosphate linkages and thus includes, but is not limited to "linked nucleotides." As used herein, "linked nucleosides" are nucleosides that are connected in a continuous sequence (i.e. no additional nucleosides are present between those that are linked).

As used herein, "nucleobase" means a group of atoms that can be linked to a sugar moiety to create a nucleoside that is capable of incorporation into an oligonucleotide, and wherein the group of atoms is capable of bonding with a complementary naturally occurring nucleobase of another oligonucleotide or nucleic acid. Nucleobases may be naturally occurring or may be modified.

As used herein, "heterocyclic base" or "heterocyclic nucleobase" means a nucleobase comprising a heterocyclic structure.

As used herein the terms, "unmodified nucleobase" or "naturally occurring nucleobase" means the naturally occurring heterocyclic nucleobases of RNA or DNA: the purine bases adenine (A) and guanine (G), and the pyrimidine bases thymine (T), cytosine (C) (including 5-methyl C), and uracil (U).

As used herein, "modified nucleobase" means any nucleobase that is not a naturally occurring nucleobase.

As used herein, "modified nucleoside" means a nucleoside comprising at least one chemical modification compared to naturally occurring RNA or DNA nucleosides. Modified nucleosides comprise a modified sugar moiety and/or a modified nucleobase.

As used herein, "bicyclic nucleoside" or "BNA" means a nucleoside comprising a bicyclic sugar moiety.

As used herein, "constrained ethyl nucleoside" or "cEt" means a nucleoside comprising a bicyclic sugar moiety comprising a 4'-CH(CH$_3$)—O-2'bridge.

As used herein, "locked nucleic acid nucleoside" or "LNA" means a nucleoside comprising a bicyclic sugar moiety comprising a 4'-CH$_2$—O-2'bridge.

As used herein, "2'-substituted nucleoside" means a nucleoside comprising a substituent at the 2'-position other than H or OH. Unless otherwise indicated, a 2'-substituted nucleoside is not a bicyclic nucleoside.

As used herein, "2'-deoxynucleoside" means a nucleoside comprising 2'-H furanosyl sugar moiety, as found in naturally occurring deoxyribonucleosides (DNA). In certain embodiments, a 2'-deoxynucleoside may comprise a modified nucleobase or may comprise an RNA nucleobase (e.g., uracil).

As used herein, "oligonucleotide" means a compound comprising a plurality of linked nucleosides. In certain embodiments, an oligonucleotide comprises one or more unmodified ribonucleosides (RNA) and/or unmodified deoxyribonucleosides (DNA) and/or one or more modified nucleosides.

As used herein "oligonucleoside" means an oligonucleotide in which none of the internucleoside linkages contains a phosphorus atom. As used herein, oligonucleotides include oligonucleosides.

As used herein, "modified oligonucleotide" means an oligonucleotide comprising at least one modified nucleoside and/or at least one modified internucleoside linkage.

As used herein "internucleoside linkage" means a covalent linkage between adjacent nucleosides in an oligonucleotide.

As used herein "naturally occurring internucleoside linkage" means a 3' to 5' phosphodiester linkage.

As used herein, "modified internucleoside linkage" means any internucleoside linkage other than a naturally occurring internucleoside linkage.

As used herein, "oligomeric compound" means a polymeric structure comprising two or more sub-structures. In certain embodiments, an oligomeric compound comprises an oligonucleotide. In certain embodiments, an oligomeric compound comprises one or more conjugate groups and/or terminal groups. In certain embodiments, an oligomeric compound consists of an oligonucleotide.

As used herein, "terminal group" means one or more atom attached to either, or both, the 3' end or the 5' end of an oligonucleotide. In certain embodiments a terminal group is a conjugate group. In certain embodiments, a terminal group comprises one or more terminal group nucleosides.

As used herein, "conjugate" means an atom or group of atoms bound to an oligonucleotide or oligomeric compound. In general, conjugate groups modify one or more properties of the compound to which they are attached, including, but not limited to pharmacodynamic, pharmacokinetic, binding, absorption, cellular distribution, cellular uptake, charge and/or clearance properties.

As used herein, "conjugate linking group" means any atom or group of atoms used to attach a conjugate to an oligonucleotide or oligomeric compound.

As used herein, "antisense compound" means a compound comprising or consisting of an oligonucleotide at least a portion of which is complementary to a target nucleic acid to which it is capable of hybridizing, resulting in at least one antisense activity.

As used herein, "antisense activity" means any detectable and/or measurable change attributable to the hybridization of an antisense compound to its target nucleic acid.

As used herein, "detecting" or "measuring" means that a test or assay for detecting or measuring is performed. Such detection and/or measuring may result in a value of zero. Thus, if a test for detection or measuring results in a finding of no activity (activity of zero), the step of detecting or measuring the activity has nevertheless been performed.

As used herein, "detectable and/or measurable activity" means a statistically significant activity that is not zero.

As used herein, "essentially unchanged" means little or no change in a particular parameter, particularly relative to another parameter which changes much more. In certain embodiments, a parameter is essentially unchanged when it changes less than 5%. In certain embodiments, a parameter is essentially unchanged if it changes less than two-fold while another parameter changes at least ten-fold. For example, in certain embodiments, an antisense activity is a change in the amount of a target nucleic acid. In certain such embodiments, the amount of a non-target nucleic acid is essentially unchanged if it changes much less than the target nucleic acid does, but the change need not be zero.

As used herein, "expression" means the process by which a gene ultimately results in a protein. Expression includes, but is not limited to, transcription, post-transcriptional modification (e.g., splicing, polyadenlyation, addition of 5'-cap), and translation.

As used herein, "target nucleic acid" means a nucleic acid molecule to which an antisense compound hybridizes.

As used herein, "mRNA" means an RNA molecule that encodes a protein.

As used herein, "pre-mRNA" means an RNA transcript that has not been fully processed into mRNA. Pre-mRNA includes one or more intron.

As used herein, "transcript" means an RNA molecule transcribed from DNA. Transcripts include, but are not limited to mRNA, pre-mRNA, and partially processed RNA.

As used herein, "targeting" or "targeted to" means the association of an antisense compound to a particular target nucleic acid molecule or a particular region of a target nucleic acid molecule. An antisense compound targets a target nucleic acid if it is sufficiently complementary to the target nucleic acid to allow hybridization under physiological conditions.

As used herein, "nucleobase complementarity" or "complementarity" when in reference to nucleobases means a nucleobase that is capable of base pairing with another nucleobase. For example, in DNA, adenine (A) is complementary to thymine (T). For example, in RNA, adenine (A) is complementary to uracil (U). In certain embodiments, complementary nucleobase means a nucleobase of an antisense compound that is capable of base pairing with a nucleobase of its target nucleic acid. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be complementary at that nucleobase pair. Nucleobases comprising certain modifications may maintain the ability to pair with a counterpart nucleobase and thus, are still capable of nucleobase complementarity.

As used herein, "non-complementary" in reference to nucleobases means a pair of nucleobases that do not form hydrogen bonds with one another.

As used herein, "complementary" in reference to oligomeric compounds (e.g., linked nucleosides, oligonucleotides, or nucleic acids) means the capacity of such oligomeric compounds or regions thereof to hybridize to another oligomeric compound or region thereof through nucleobase complementarity under stringent conditions. Complementary oligomeric compounds need not have nucleobase complementarity at each nucleoside. Rather, some mismatches are tolerated. In certain embodiments, complementary oligomeric compounds or regions are complementary at 70% of the nucleobases (70% complementary). In certain embodiments, complementary oligomeric compounds or regions are 80% complementary. In certain embodiments, complementary oligomeric compounds or regions are 90% complementary. In certain embodiments, complementary oligomeric compounds or regions are 95% complementary. In certain embodiments, complementary oligomeric compounds or regions are 100% complementary.

As used herein, "hybridization" means the pairing of complementary oligomeric compounds (e.g., an antisense compound and its target nucleic acid). While not limited to a particular mechanism, the most common mechanism of pairing involves hydrogen bonding, which may be Watson-Crick, Hoogsteen or reversed Hoogsteen hydrogen bonding, between complementary nucleobases.

As used herein, "specifically hybridizes" means the ability of an oligomeric compound to hybridize to one nucleic acid site with greater affinity than it hybridizes to another nucleic acid site. In certain embodiments, an antisense oligonucleotide specifically hybridizes to more than one target site.

As used herein, "percent complementarity" means the percentage of nucleobases of an oligomeric compound that are complementary to an equal-length portion of a target nucleic acid. Percent complementarity is calculated by dividing the number of nucleobases of the oligomeric compound that are complementary to nucleobases at corresponding positions in the target nucleic acid by the total length of the oligomeric compound.

As used herein, "percent identity" means the number of nucleobases in a first nucleic acid that are the same type (independent of chemical modification) as nucleobases at corresponding positions in a second nucleic acid, divided by the total number of nucleobases in the first nucleic acid.

As used herein, "modulation" means a change of amount or quality of a molecule, function, or activity when compared to the amount or quality of a molecule, function, or activity prior to modulation. For example, modulation includes the change, either an increase (stimulation or induction) or a decrease (inhibition or reduction) in gene expression. As a further example, modulation of expression can include a change in splice site selection of pre-mRNA processing, resulting in a change in the absolute or relative amount of a particular splice-variant compared to the amount in the absence of modulation.

As used herein, "motif" means a pattern of chemical modifications in an oligomeric compound or a region thereof. Motifs may be defined by modifications at certain nucleosides and/or at certain linking groups of an oligomeric compound.

As used herein, "nucleoside motif" means a pattern of nucleoside modifications in an oligomeric compound or a region thereof. The linkages of such an oligomeric compound may be modified or unmodified. Unless otherwise indicated, motifs herein describing only nucleosides are intended to be nucleoside motifs. Thus, in such instances, the linkages are not limited.

As used herein, "sugar motif" means a pattern of sugar modifications in an oligomeric compound or a region thereof.

As used herein, "linkage motif" means a pattern of linkage modifications in an oligomeric compound or region thereof. The nucleosides of such an oligomeric compound may be modified or unmodified. Unless otherwise indicated, motifs herein describing only linkages are intended to be linkage motifs. Thus, in such instances, the nucleosides are not limited.

As used herein, "nucleobase modification motif" means a pattern of modifications to nucleobases along an oligonucleotide. Unless otherwise indicated, a nucleobase modification motif is independent of the nucleobase sequence.

As used herein, "sequence motif" means a pattern of nucleobases arranged along an oligonucleotide or portion thereof. Unless otherwise indicated, a sequence motif is independent of chemical modifications and thus may have any combination of chemical modifications, including no chemical modifications.

As used herein, "type of modification" in reference to a nucleoside or a nucleoside of a "type" means the chemical modification of a nucleoside and includes modified and unmodified nucleosides. Accordingly, unless otherwise indicated, a "nucleoside having a modification of a first type" may be an unmodified nucleoside.

As used herein, "differently modified" mean chemical modifications or chemical substituents that are different from one another, including absence of modifications. Thus, for example, a MOE nucleoside and an unmodified DNA nucleoside are "differently modified," even though the DNA nucleoside is unmodified. Likewise, DNA and RNA are "differently modified," even though both are naturally-occurring unmodified nucleosides. Nucleosides that are the same but for comprising different nucleobases are not differently modified. For example, a nucleoside comprising a 2'-OMe modified sugar and an unmodified adenine nucleobase and a nucleoside comprising a 2'-OMe modified sugar and an unmodified thymine nucleobase are not differently modified.

As used herein, "the same type of modifications" refers to modifications that are the same as one another, including absence of modifications. Thus, for example, two unmodified DNA nucleoside have "the same type of modification," even though the DNA nucleoside is unmodified. Such nucleosides having the same type modification may comprise different nucleobases.

As used herein, "pharmaceutically acceptable carrier or diluent" means any substance suitable for use in administering to an animal. In certain embodiments, a pharmaceutically acceptable carrier or diluent is sterile saline. In certain embodiments, such sterile saline is pharmaceutical grade saline.

As used herein, "substituent" and "substituent group," means an atom or group that replaces the atom or group of a named parent compound. For example a substituent of a modified nucleoside is any atom or group that differs from the atom or group found in a naturally occurring nucleoside (e.g., a modified 2'-substituent is any atom or group at the 2'-position of a nucleoside other than H or OH). Substituent groups can be protected or unprotected. In certain embodiments, compounds of the present invention have substituents at one or at more than one position of the parent compound. Substituents may also be further substituted with other substituent groups and may be attached directly or via a linking group such as an alkyl or hydrocarbyl group to a parent compound.

Likewise, as used herein, "substituent" in reference to a chemical functional group means an atom or group of atoms differs from the atom or a group of atoms normally present in the named functional group. In certain embodiments, a substituent replaces a hydrogen atom of the functional group (e.g., in certain embodiments, the substituent of a substituted methyl group is an atom or group other than hydrogen which replaces one of the hydrogen atoms of an unsubstituted methyl group). Unless otherwise indicated, groups amenable for use as substituents include without limitation, halogen, hydroxyl, alkyl, alkenyl, alkynyl, acyl (—C(O)$R_{aa}$), carboxyl (—C(O)O—$R_{aa}$), aliphatic groups, alicyclic groups, alkoxy, substituted oxy (—O—$R_{aa}$), aryl, aralkyl, heterocyclic radical, heteroaryl, heteroarylalkyl, amino (—N($R_{bb}$)($R_{cc}$)), imino(=$NR_{bb}$), amido (—C(O)N($R_{bb}$)($R_{cc}$) or —N($R_{bb}$)C(O)$R_{aa}$), azido (—$N_3$), nitro (—$NO_2$), cyano (—CN), carbamido (—OC(O)N($R_{bb}$)($R_{cc}$) or —N($R_{bb}$)C(O)O$R_{aa}$), ureido (—N($R_{bb}$)C(O)N($R_{bb}$)($R_{cc}$)), thioureido (—N($R_{bb}$)C(S)N($R_{bb}$)—($R_{cc}$)), guanidinyl (—N($R_{bb}$)C(=$NR_{bb}$)N($R_{bb}$)($R_{cc}$)), amidinyl (—C(=$NR_{bb}$)N($R_{bb}$)($R_{cc}$) or —N($R_{bb}$)C(=$NR_{bb}$)($R_{aa}$)), thiol (—$SR_{bb}$), sulfinyl (—S(O)$R_{bb}$), sulfonyl (—S(O)$_2R_{bb}$) and sulfonamidyl (—S(O)$_2$N($R_{bb}$)($R_{cc}$) or —N($R_{bb}$)S—(O)$_2R_{bb}$). Wherein each $R_{aa}$, $R_{bb}$ and $R_{cc}$ is, independently, H, an optionally linked chemical functional group or a further substituent group with a preferred list including without limitation, alkyl, alkenyl, alkynyl, aliphatic, alkoxy, acyl, aryl, aralkyl, heteroaryl, alicyclic, heterocyclic and heteroarylalkyl. Selected substituents within the compounds described herein are present to a recursive degree.

As used herein, "alkyl," as used herein, means a saturated straight or branched hydrocarbon radical containing up to twenty four carbon atoms. Examples of alkyl groups include without limitation, methyl, ethyl, propyl, butyl, isopropyl, n-hexyl, octyl, decyl, dodecyl and the like. Alkyl groups typically include from 1 to about 24 carbon atoms, more typically from 1 to about 12 carbon atoms ($C_1$-$C_{12}$ alkyl) with from 1 to about 6 carbon atoms being more preferred.

As used herein, "alkenyl," means a straight or branched hydrocarbon chain radical containing up to twenty four carbon atoms and having at least one carbon-carbon double bond. Examples of alkenyl groups include without limitation, ethenyl, propenyl, butenyl, 1-methyl-2-buten-1-yl, dienes such as 1,3-butadiene and the like. Alkenyl groups typically include from 2 to about 24 carbon atoms, more typically from 2 to about 12 carbon atoms with from 2 to about 6 carbon atoms being more preferred. Alkenyl groups as used herein may optionally include one or more further substituent groups.

As used herein, "alkynyl," means a straight or branched hydrocarbon radical containing up to twenty four carbon atoms and having at least one carbon-carbon triple bond. Examples of alkynyl groups include, without limitation, ethynyl, 1-propynyl, 1-butynyl, and the like. Alkynyl groups typically include from 2 to about 24 carbon atoms, more typically from 2 to about 12 carbon atoms with from 2 to about 6 carbon atoms being more preferred. Alkynyl groups as used herein may optionally include one or more further substituent groups.

As used herein, "acyl," means a radical formed by removal of a hydroxyl group from an organic acid and has the general Formula —C(O)—X where X is typically aliphatic, alicyclic or aromatic. Examples include aliphatic carbonyls, aromatic carbonyls, aliphatic sulfonyls, aromatic sulfinyls, aliphatic sulfinyls, aromatic phosphates, aliphatic phosphates and the like. Acyl groups as used herein may optionally include further substituent groups.

As used herein, "alicyclic" means a cyclic ring system wherein the ring is aliphatic. The ring system can comprise one or more rings wherein at least one ring is aliphatic. Preferred alicyclics include rings having from about 5 to about 9 carbon atoms in the ring. Alicyclic as used herein may optionally include further substituent groups.

As used herein, "aliphatic" means a straight or branched hydrocarbon radical containing up to twenty four carbon atoms wherein the saturation between any two carbon atoms is a single, double or triple bond. An aliphatic group preferably contains from 1 to about 24 carbon atoms, more typically from 1 to about 12 carbon atoms with from 1 to about 6 carbon atoms being more preferred. The straight or branched chain of an aliphatic group may be interrupted with one or more heteroatoms that include nitrogen, oxygen, sulfur and phosphorus. Such aliphatic groups interrupted by heteroatoms include without limitation, polyalkoxys, such as polyalkylene glycols, polyamines, and polyimines. Aliphatic groups as used herein may optionally include further substituent groups.

As used herein, "alkoxy" means a radical formed between an alkyl group and an oxygen atom wherein the oxygen atom is used to attach the alkoxy group to a parent molecule. Examples of alkoxy groups include without limitation, methoxy, ethoxy, propoxy, isopropoxy, n-butoxy, sec-butoxy, tert-butoxy, n-pentoxy, neopentoxy, n-hexoxy and the like. Alkoxy groups as used herein may optionally include further substituent groups.

As used herein, "aminoalkyl" means an amino substituted $C_1$-$C_{12}$ alkyl radical. The alkyl portion of the radical forms a covalent bond with a parent molecule. The amino group can be located at any position and the aminoalkyl group can be substituted with a further substituent group at the alkyl and/or amino portions.

As used herein, "aralkyl" and "arylalkyl" mean an aromatic group that is covalently linked to a $C_1$-$C_{12}$ alkyl radical. The alkyl radical portion of the resulting aralkyl (or arylalkyl) group forms a covalent bond with a parent molecule. Examples include without limitation, benzyl, phenethyl and the like. Aralkyl groups as used herein may optionally include further substituent groups attached to the alkyl, the aryl or both groups that form the radical group.

As used herein, "aryl" and "aromatic" mean a mono- or polycyclic carbocyclic ring system radicals having one or more aromatic rings. Examples of aryl groups include without limitation, phenyl, naphthyl, tetrahydronaphthyl, indanyl, idenyl and the like. Preferred aryl ring systems have from about 5 to about 20 carbon atoms in one or more rings. Aryl groups as used herein may optionally include further substituent groups.

As used herein, "halo" and "halogen," mean an atom selected from fluorine, chlorine, bromine and iodine.

As used herein, "heteroaryl," and "heteroaromatic," mean a radical comprising a mono- or poly-cyclic aromatic ring, ring system or fused ring system wherein at least one of the rings is aromatic and includes one or more heteroatoms. Heteroaryl is also meant to include fused ring systems including systems where one or more of the fused rings contain no heteroatoms. Heteroaryl groups typically include one ring atom selected from sulfur, nitrogen or oxygen. Examples of heteroaryl groups include without limitation, pyridinyl, pyrazinyl, pyrimidinyl, pyrrolyl, pyrazolyl, imidazolyl, thiazolyl, oxazolyl, isooxazolyl, thiadiazolyl, oxadiazolyl, thiophenyl, furanyl, quinolinyl, isoquinolinyl, benzimidazolyl, benzooxazolyl, quinoxalinyl and the like. Heteroaryl radicals can be attached to a parent molecule directly or through a linking moiety such as an aliphatic group or hetero atom. Heteroaryl groups as used herein may optionally include further substituent groups.

Oligomeric Compounds

In certain embodiments, the present invention provides oligomeric compounds. In certain embodiments, such oligomeric compounds comprise oligonucleotides optionally comprising one or more conjugate and/or terminal groups. In certain embodiments, an oligomeric compound consists of an oligonucleotide. In certain embodiments, oligonucleotides comprise one or more chemical modifications. Such chemical modifications include modifications one or more nucleoside (including modifications to the sugar moiety and/or the nucleobase) and/or modifications to one or more internucleoside linkage. In certain embodiments, an oligomeric compound consists of a phosphorodiamidite morpholino oligomer.

Certain Sugar Moieties

In certain embodiments, oligomeric compounds of the invention comprise one or more modified nucleosides comprising a modified sugar moiety. Such oligomeric compounds comprising one or more sugar-modified nucleosides may have desirable properties, such as enhanced nuclease stability or increased binding affinity with a target nucleic acid relative to oligomeric compounds comprising only nucleosides comprising naturally occurring sugar moieties. In certain embodiments, modified sugar moieties are substituted sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of substituted sugar moieties.

In certain embodiments, modified sugar moieties are substituted sugar moieties comprising one or more substituent, including but not limited to substituents at the 2' and/or 5' positions. Examples of sugar substituents suitable for the 2'-position, include, but are not limited to: 2'-F, 2'-OCH$_3$ ("OMe" or "O-methyl"), and 2'-O(CH$_2$)$_2$OCH$_3$ ("MOE"). In certain embodiments, sugar substituents at the 2' position is selected from allyl, amino, azido, thio, O-allyl, O—C$_1$-C$_{10}$ alkyl, O—C$_1$-C$_{10}$ substituted alkyl; O—C$_1$-C$_{10}$ alkoxy; O—C$_1$-C$_{10}$ substituted alkoxy, OCF$_3$, O(CH$_2$)$_2$SCH$_3$, O(CH$_2$)$_2$—O—N(Rm)(Rn), and O—CH$_2$—C(=O)—N(Rm)(Rn), where each Rm and Rn is, independently, H or substituted or unsubstituted C$_1$-C$_{10}$ alkyl. Examples of sugar substituents at the 5'-position, include, but are not limited to: 5'-methyl (R or S); 5'-vinyl, and 5'-methoxy. In certain embodiments, substituted sugars comprise more than one non-bridging sugar substituent, for example, 2'-F-5'-methyl sugar moieties (see, e.g., PCT International Application WO 2008/101157, for additional 5', 2'-bis substituted sugar moieties and nucleosides).

Nucleosides comprising 2'-substituted sugar moieties are referred to as 2'-substituted nucleosides. In certain embodiments, a 2'-substituted nucleoside comprises a 2'-substituent group selected from halo, allyl, amino, azido, O—C$_1$-C$_{10}$ alkoxy; O—C$_1$-C$_{10}$ substituted alkoxy, SH, CN, OCN, CF$_3$, OCF$_3$, O-alkyl, S-alkyl, N(R$_m$)-alkyl; O-alkenyl, S-alkenyl, or N(R$_m$)-alkenyl; O-alkynyl, S-alkynyl, N(R$_m$)-alkynyl; O-alkylenyl-O-alkyl, alkynyl, alkaryl, aralkyl, O-alkaryl, O-aralkyl, O(CH$_2$)$_2$SCH$_3$, O—(CH$_2$)$_2$—O—N(R$_m$)(R$_n$) or O—CH$_2$—C(=O)—N(R$_m$)(R$_n$), where each R$_m$ and R$_n$ is, independently, H, an amino protecting group or substituted or unsubstituted C$_1$-C$_{10}$ alkyl. These 2'-substituent groups can be further substituted with one or more substituent groups independently selected from hydroxyl, amino, alkoxy, carboxy, benzyl, phenyl, nitro (NO$_2$), thiol, thioalkoxy (S-alkyl), halogen, alkyl, aryl, alkenyl and alkynyl.

In certain embodiments, a 2'-substituted nucleoside comprises a 2'-substituent group selected from F, NH$_2$, N$_3$, OCF$_3$, O—CH$_3$, O(CH$_2$)$_3$NH$_2$, CH$_2$—CH=CH$_2$, O—CH$_2$—CH=CH$_2$, OCH$_2$CH$_2$OCH$_3$, O(CH$_2$)$_2$SCH$_3$, O—(CH$_2$)$_2$—O—N(R$_m$)(R$_n$), O(CH$_2$)$_2$O(CH$_2$)$_2$N(CH$_3$)$_2$, and N-substituted acetamide (O—CH$_2$—C(=O)—N(R$_m$)(R$_n$)) where each R$_m$ and R$_n$ is, independently, H, an amino protecting group or substituted or unsubstituted C$_1$-C$_{10}$ alkyl.

In certain embodiments, a 2'-substituted nucleoside comprises a sugar moiety comprising a 2'-substituent group selected from F, OCF$_3$, O—CH$_3$, OCH$_2$CH$_2$OCH$_3$, O(CH$_2$)$_2$SCH$_3$, O—(CH$_2$)$_2$—O—N(CH$_3$)$_2$, —O(CH$_2$)$_2$O(CH$_2$)$_2$N(CH$_3$)$_2$, and O—CH$_2$—C(=O)—N(H)CH$_3$.

In certain embodiments, a 2'-substituted nucleoside comprises a sugar moiety comprising a 2'-substituent group selected from F, O—CH$_3$, and OCH$_2$CH$_2$OCH$_3$.

Certain modified sugar moieties comprise a bridging sugar substituent that forms a second ring resulting in a bicyclic sugar moiety. In certain such embodiments, the bicyclic sugar moiety comprises a bridge between the 4' and the 2' furanose ring atoms. Examples of such 4' to 2' sugar substituents, include, but are not limited to: —[C(R$_a$)(R$_b$)]$_n$—, —[C(R$_a$)(R$_b$)]$_n$—O—, —C(R$_a$R$_b$)—N(R)—O— or, —C(R$_a$R$_b$)—O—N(R)—; 4'- CH$_2$-2', 4'-(CH$_2$)$_2$-2', 4'-(CH$_2$)$_3$-2', 4'-(CH$_2$)—O—2' (LNA); 4'-(CH$_2$)—S-2'; 4'-(CH$_2$)$_2$—O—2' (ENA); 4'-CH(CH$_3$)—O—2' (cEt) and 4'-CH(CH$_2$OCH$_3$)—O—2', and analogs thereof (see, e.g., U.S. Pat. No. 7,399,845, issued on Jul. 15, 2008); 4'-C(CH$_3$)(CH$_3$)—O—2' and analogs thereof, (see, e.g., WO2009/006478, published Jan. 8, 2009); 4'-CH$_2$—N(OCH$_3$)-2' and analogs thereof (see, e.g., WO2008/150729, published Dec. 11, 2008); 4'-CH$_2$—O—N(CH$_3$)-2' (see, e.g., US2004/0171570, published Sep. 2, 2004); 4'-CH$_2$—O—N(R)-2', and 4'-CH$_2$—N(R)—O—2'-, wherein each R is, independently, H, a protecting group, or C$_1$-C$_{12}$ alkyl; 4'-CH$_2$—N(R)—O—2', wherein R is H, C$_1$-C$_{12}$ alkyl, or a protecting group (see, U.S. Pat. No. 7,427,672, issued on Sep. 23, 2008); 4'-CH$_2$—C(H)(CH$_3$)-2' (see, e.g., Chattopadhyaya, et al., *J. Org. Chem.*, 2009, 74, 118-134); and 4'-CH$_2$—C(=CH$_2$)-2' and analogs thereof (see, published PCT International Application WO 2008/154401, published on Dec. 8, 2008).

In certain embodiments, such 4' to 2' bridges independently comprise from 1 to 4 linked groups independently selected from —[C(R$_a$)(R$_b$)]$_n$—, —C(R$_a$)=C(R$_b$)—, —C(R$_a$)=N—, —C(=NR$_a$)—, —C(=O), —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl, or a protecting group.

Nucleosides comprising bicyclic sugar moieties are referred to as bicyclic nucleosides or BNAs. Bicyclic nucleosides include, but are not limited to, (A) α-L-Methyleneoxy (4'-CH$_2$—O—2') BNA, (B) β-D-Methyleneoxy (4'-CH$_2$—O—2') BNA (also referred to as locked nucleic acid or LNA), (C) Ethyleneoxy (4'-(CH$_2$)$_2$—O—2') BNA, (D) Aminooxy (4'-CH$_2$—O—N(R)-2') BNA, (E) Oxyamino (4'-CH$_2$—N(R)—O—2') BNA, (F) Methyl(methyleneoxy) (4'-CH(CH$_3$)—O—2') BNA (also referred to as constrained ethyl or cEt), (G) methylene-thio (4'-CH$_2$—S-2') BNA, (H) methylene-amino (4'-CH2-N(R)-2') BNA, (I) methyl carbocyclic (4'-CH$_2$—CH(CH$_3$)-2') BNA, and (J) propylene carbocyclic (4'-(CH$_2$)$_3$-2') BNA as depicted below.

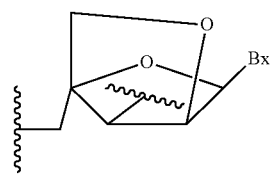
(A)

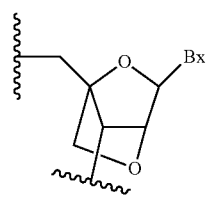
(B)

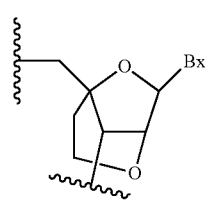
(C)

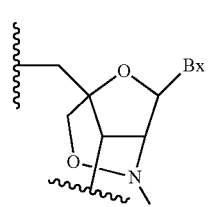
(D)

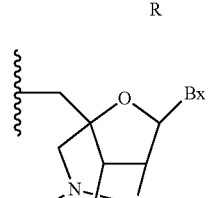
(E)

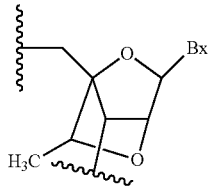
(F)

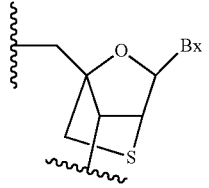
(G)

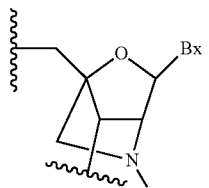
(H)

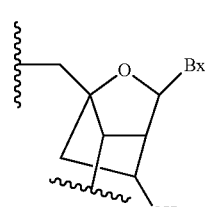
(I)

(J)

wherein Bx is a nucleobase moiety and R is, independently, H, a protecting group, or C$_1$-C$_{12}$ alkyl.

Additional bicyclic sugar moieties are known in the art, for example: Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 129(26) 8362-8379 (Jul. 4, 2007); Elayadi et al., *Curr. Opinion Invens. Drugs*, 2001, 2, 558-561; Braasch et al., *Chem. Biol.*, 2001, 8, 1-7; Orum et al., *Curr. Opinion Mol. Ther.*, 2001, 3, 239-243; U.S. Pat. Nos. 7,053,207, 6,268,490, 6,770,748, 6,794,499, 7,034,133, 6,525,191, 6,670,461, and 7,399,845; WO 2004/106356, WO 1994/14226, WO 2005/021570, and WO 2007/134181; U.S. Patent Publication Nos. US2004/0171570, US2007/0287831, and US2008/0039618; U.S. patent Ser. Nos. 12/129,154, 60/989,574, 61/026,995, 61/026,998, 61/056,564, 61/086,231, 61/097,787, and 61/099,844; and PCT International Applications Nos. PCT/US2008/064591, PCT/US2008/066154, and PCT/US2008/068922.

In certain embodiments, bicyclic sugar moieties and nucleosides incorporating such bicyclic sugar moieties are further defined by isomeric configuration. For example, a nucleoside comprising a 4'-2' methylene-oxy bridge, may be in the α-L configuration or in the β-D configuration. Previously, α-L-methyleneoxy (4'-CH$_2$—O—2') bicyclic nucleosides have been incorporated into antisense oligonucleotides that showed antisense activity (Frieden et al., *Nucleic Acids Research*, 2003, 21, 6365-6372).

In certain embodiments, substituted sugar moieties comprise one or more non-bridging sugar substituent and one or more bridging sugar substituent (e.g., 5'-substituted and 4'-2' bridged sugars). (see, PCT International Application WO 2007/134181, published on Nov. 22, 2007, wherein LNA is substituted with, for example, a 5'-methyl or a 5'-vinyl group).

In certain embodiments, modified sugar moieties are sugar surrogates. In certain such embodiments, the oxygen atom of the naturally occurring sugar is substituted, e.g., with a sulfer, carbon or nitrogen atom. In certain such embodiments, such modified sugar moiety also comprises bridging and/or non-bridging substituents as described above. For example, certain sugar surrogates comprise a 4'-sulfer atom and a substitution at the 2'-position (see, e.g., published U.S. Patent Application US2005/0130923, published on Jun. 16, 2005) and/or the 5' position. By way of additional example, carbocyclic bicyclic nucleosides having a 4'-2' bridge have been described (see, e.g., Freier et al., *Nucleic Acids Research*, 1997, 25(22), 4429-4443 and Albaek et al., *J. Org. Chem.*, 2006, 71, 7731-7740).

In certain embodiments, sugar surrogates comprise rings having other than 5-atoms. For example, in certain embodiments, a sugar surrogate comprises a six-membered tetrahydropyran. Such tetrahydropyrans may be further modified or substituted. Nucleosides comprising such modified tetrahydropyrans include, but are not limited to, hexitol nucleic acid (HNA), anitol nucleic acid (ANA), manitol nucleic acid (MNA) (see Leumann, C J. *Bioorg. &Med. Chem.* (2002) 10:841-854), fluoro HNA (F-HNA), and those compounds having Formula VII:

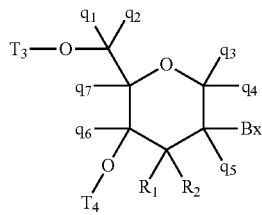

VII wherein independently for each of said at least one tetrahydropyran nucleoside analog of Formula VII:

Bx is a nucleobase moiety;

$T_3$ and $T_4$ are each, independently, an internucleoside linking group linking the tetrahydropyran nucleoside analog to the antisense compound or one of $T_3$ and $T_4$ is an internucleoside linking group linking the tetrahydropyran nucleoside analog to the antisense compound and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, the modified THP nucleosides of Formula VII are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, THP nucleosides of Formula VII are provided wherein one of $R_1$ and $R_2$ is F. In certain embodiments, $R_1$ is fluoro and $R_2$ is H, $R_1$ is methoxy and $R_2$ is H, and $R_1$ is methoxyethoxy and $R_2$ is H.

Many other bicyclic and tricyclic sugar and sugar surrogate ring systems are known in the art that can be used to modify nucleosides (see, e.g., review article: Leumann, J. C, *Bioorganic & Medicinal Chemistry*, 2002, 10, 841-854).

In certain embodiments, sugar surrogates comprise rings having more than 5 atoms and more than one heteroatom. For example nucleosides comprising morpholino sugar moieties and their use in oligomeric compounds has been reported (see for example: Braasch et al., Biochemistry, 2002, 41, 4503-4510; and U.S. Pat. Nos. 5,698,685; 5,166, 315; 5,185,444; and 5,034,506). As used here, the term "morpholino" means a sugar surrogate having the following structure:

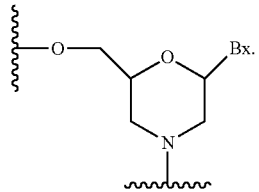

In certain embodiments, morpholinos may be modified, for example by adding or altering various substituent groups from the above morpholino structure. Such sugar surrogates are referred to herein as "modified morpholinos."

Combinations of modifications are also provided without limitation, such as 2'-F-5'-methyl substituted nucleosides (see PCT International Application WO 2008/101157 Published on Aug. 21, 2008 for other disclosed 5', 2'-bis substituted nucleosides) and replacement of the ribosyl ring oxygen atom with S and further substitution at the 2'-position (see published U.S. Patent Application US2005-0130923, published on Jun. 16, 2005) or alternatively 5'-substitution of a bicyclic nucleic acid (see PCT International Application WO 2007/134181, published on Nov. 22, 2007 wherein a 4'-CH$_2$—O—2' bicyclic nucleoside is further substituted at the 5' position with a 5'-methyl or a 5'-vinyl group). The synthesis and preparation of carbocyclic bicyclic nucleosides along with their oligomerization and biochemical studies have also been described (see, e.g., Srivastava et al., *J. Am. Chem. Soc.* 2007, 129(26), 8362-8379).

Certain Nucleobases

In certain embodiments, nucleosides of the present invention comprise one or more unmodified nucleobases. In certain embodiments, nucleosides of the present invention comprise one or more modified nucleobases.

In certain embodiments, modified nucleobases are selected from: universal bases, hydrophobic bases, promiscuous bases, size-expanded bases, and fluorinated bases as defined herein. 5-substituted pyrimidines, 6-azapyrimidines and N-2, N-6 and O—6 substituted purines, including 2-aminopropyladenine, 5-propynyluracil; 5-propynylcytosine; 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH$_3$) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine, 3-deazaguanine and 3-deazaadenine, universal bases, hydrophobic bases, promiscuous bases, size-expanded bases, and fluorinated bases as defined herein. Further modified nucleobases include tricyclic pyrimidines such as phenoxazine cytidine([5,4-b][1,4]benzoxazin-2 (3H)-one), phenothiazine cytidine (1H-pyrimido[5,4-b][1,4] benzothiazin-2(3H)-one), G-clamps such as a substituted phenoxazine cytidine (e.g. 9-(2-aminoethoxy)-H-pyrimido [5,4-b][1,4]benzoxazin-2(3H)-one), carbazole cytidine (2H-pyrimido[4,5-b]indol-2-one), pyridoindole cytidine (H-pyrido[3',2':4,5]pyrrolo[2,3-d]pyrimidin-2-one). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in U.S. Pat. No. 3,687,808, those disclosed in *The Concise Encyclopedia Of Polymer Science And Engineering*, Kroschwitz, J. I., Ed., John Wiley & Sons, 1990, 858-859; those disclosed by Englisch et al., *Angewandte Chemie*, International Edition, 1991, 30, 613; and those disclosed by Sanghvi, Y. S., Chapter 15, *Antisense Research and Applications*, Crooke, S. T. and Lebleu, B., Eds., CRC Press, 1993, 273-288.

Representative United States patents that teach the preparation of certain of the above noted modified nucleobases as well as other modified nucleobases include without limitation, U.S. Pat. Nos. 3,687,808; 4,845,205; 5,130,302; 5,134, 066; 5,175,273; 5,367,066; 5,432,272; 5,457,187; 5,459, 255; 5,484,908; 5,502,177; 5,525,711; 5,552,540; 5,587, 469; 5,594,121; 5,596,091; 5,614,617; 5,645,985; 5,681, 941; 5,750,692; 5,763,588; 5,830,653 and 6,005,096, certain of which are commonly owned with the instant application, and each of which is herein incorporated by reference in its entirety.

Certain Internucleoside Linkages

In certain embodiments, the present invention provides oligomeric compounds comprising linked nucleosides. In such embodiments, nucleosides may be linked together using any internucleoside linkage. The two main classes of internucleoside linking groups are defined by the presence or absence of a phosphorus atom. Representative phosphorus containing internucleoside linkages include, but are not limited to, phosphodiesters (P=O), phosphotriesters, methylphosphonates, phosphoramidate, and phosphorothioates (P=S). Representative non-phosphorus containing internucleoside linking groups include, but are not limited to, methylenemethylimino (—CH$_2$—N(CH$_3$)—O—CH$_2$—), thiodiester (—O—C(O)—S—), thionocarbamate (—O—C(O)(NH)—S—); siloxane (—O—Si(H)$_2$—O—); and N,N'-dimethylhydrazine (—CH$_2$—N(CH$_3$)—N(CH$_3$)—). Modified linkages, compared to natural phosphodiester linkages, can be used to alter, typically increase, nuclease resistance of the oligomeric compound. In certain embodiments, internucleoside linkages having a chiral atom can be prepared as a racemic mixture, or as separate enantiomers. Representative chiral linkages include, but are not limited to, alkylphosphonates and phosphorothioates. Methods of preparation of phosphorous-containing and non-phosphorous-containing internucleoside linkages are well known to those skilled in the art.

The oligonucleotides described herein contain one or more asymmetric centers and thus give rise to enantiomers, diastereomers, and other stereoisomeric configurations that may be defined, in terms of absolute stereochemistry, as (R) or (S), α or β such as for sugar anomers, or as (D) or (L) such as for amino acids etc. Included in the antisense compounds provided herein are all such possible isomers, as well as their racemic and optically pure forms.

Neutral internucleoside linkages include without limitation, phosphotriesters, methylphosphonates, MMI (3'-CH$_2$—N(CH$_3$)—O—5'), amide-3 (3'-CH$_2$—C(=O)—N (H)-5'), amide-4 (3'-CH$_2$—N(H)—C(=O)-5'), formacetal (3'-O—CH$_2$—O—5'), and thioformacetal (3'-S—CH$_2$—O—5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and CH$_2$ component parts.

Certain Motifs

In certain embodiments, the present invention provides oligomeric compounds comprising oligonucleotides. In certain embodiments, such oligonucleotides comprise one or more chemical modification. In certain embodiments, chemically modified oligonucleotides comprise one or more modified nucleosides. In certain embodiments, chemically modified oligonucleotides comprise one or more modified nucleosides comprising modified sugars. In certain embodiments, chemically modified oligonucleotides comprise one or more modified nucleosides comprising one or more modified nucleobases. In certain embodiments, chemically modified oligonucleotides comprise one or more modified internucleoside linkages. In certain embodiments, the chemically modifications (sugar modifications, nucleobase modifications, and/or linkage modifications) define a pattern or motif. In certain embodiments, the patterns of chemical modifications of sugar moieties, internucleoside linkages, and nucleobases are each independent of one another. Thus, an oligonucleotide may be described by its sugar modification motif, internucleoside linkage motif and/or nucleobase modification motif (as used herein, nucleobase modification motif describes the chemical modifications to the nucleobases independent of the sequence of nucleobases).

Certain Sugar Motifs

In certain embodiments, oligonucleotides comprise one or more type of modified sugar moieties and/or naturally occurring sugar moieties arranged along an oligonucleotide or region thereof in a defined pattern or sugar modification motif Such motifs may include any of the sugar modifications discussed herein and/or other known sugar modifications.

In certain embodiments, the oligonucleotides comprise or consist of a region having a gapmer sugar modification motif, which comprises two external regions or "wings" and an internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap. In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar modification motifs of the two wings are the same as one another (symmetric gapmer). In certain embodiments, the sugar modification motifs of the 5'-wing differs from the sugar modification motif of the 3'-wing (asymmetric gapmer). In certain embodiments, oligonucleotides comprise 2'-MOE modified nucleosides in the wings and 2'-F modified nucleosides in the gap.

In certain embodiments, oligonucleotides are fully modified. In certain such embodiments, oligonucleotides are uniformly modified. In certain embodiments, oligonucleotides are uniform 2'-MOE. In certain embodiments, oligonucleotides are uniform 2'-F. In certain embodiments, oligonucleotides are uniform morpholino. In certain embodiments, oligonucleotides are uniform BNA. In certain embodiments, oligonucleotides are uniform LNA. In certain embodiments, oligonucleotides are uniform cEt.

In certain embodiments, oligonucleotides comprise a uniformly modified region and additional nucleosides that are unmodified or differently modified. In certain embodiments, the uniformly modified region is at least 5, 10, 15, or 20 nucleosides in length. In certain embodiments, the uniform region is a 2'-MOE region. In certain embodiments, the uniform region is a 2'-F region. In certain embodiments, the uniform region is a morpholino region. In certain embodiments, the uniform region is a BNA region. In certain embodiments, the uniform region is a LNA region. In certain embodiments, the uniform region is a cEt region.

In certain embodiments, the oligonucleotide does not comprise more than 4 contiguous unmodified 2'-deoxynucleosides. In certain circumstances, antisesense oligonucleotides comprising more than 4 contiguous 2'-deoxynucleosides activate RNase H, resulting in cleavage of the target RNA. In certain embodiments, such cleavage is avoided by not having more than 4 contiguous 2'-deoxynucleosides, for example, where alteration of splicing and not cleavage of a target RNA is desired.

Certain Internucleoside Linkage Motifs

In certain embodiments, oligonucleotides comprise modified internucleoside linkages arranged along the oligonucleotide or region thereof in a defined pattern or modified internucleoside linkage motif. In certain embodiments, internucleoside linkages are arranged in a gapped motif, as described above for sugar modification motif. In such embodiments, the internucleoside linkages in each of two wing regions are different from the internucleoside linkages in the gap region. In certain embodiments the internucleoside linkages in the wings are phosphodiester and the internucleoside linkages in the gap are phosphorothioate. The sugar modification motif is independently selected, so such oligonucleotides having a gapped internucleoside linkage motif may or may not have a gapped sugar modification motif and if it does have a gapped sugar motif, the wing and gap lengths may or may not be the same.

In certain embodiments, oligonucleotides comprise a region having an alternating internucleoside linkage motif.

In certain embodiments, oligonucleotides of the present invention comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

Certain Nucleobase Modification Motifs

In certain embodiments, oligonucleotides comprise chemical modifications to nucleobases arranged along the oligonucleotide or region thereof in a defined pattern or nucleobases modification motif. In certain such embodiments, nucleobase modifications are arranged in a gapped motif. In certain embodiments, nucleobase modifications are arranged in an alternating motif. In certain embodiments, each nucleobase is modified. In certain embodiments, none of the nucleobases is chemically modified.

In certain embodiments, oligonucleotides comprise a block of modified nucleobases. In certain such embodiments, the block is at the 3'-end of the oligonucleotide. In certain embodiments the block is within 3 nucleotides of the 3'-end of the oligonucleotide. In certain such embodiments, the block is at the 5'-end of the oligonucleotide. In certain embodiments the block is within 3 nucleotides of the 5'-end of the oligonucleotide.

In certain embodiments, nucleobase modifications are a function of the natural base at a particular position of an oligonucleotide. For example, in certain embodiments each purine or each pyrimidine in an oligonucleotide is modified. In certain embodiments, each adenine is modified. In certain embodiments, each guanine is modified. In certain embodiments, each thymine is modified. In certain embodiments, each cytosine is modified. In certain embodiments, each uracil is modified.

In certain embodiments, some, all, or none of the cytosine moieties in an oligonucleotide are 5-methyl cytosine moieties. Herein, 5-methyl cytosine is not a "modified nucleobase." Accordingly, unless otherwise indicated, unmodified nucleobases include both cytosine residues having a 5-methyl and those lacking a 5 methyl. In certain embodiments, the methylation state of all or some cytosine nucleobases is specified.

Certain Overall Lengths

In certain embodiments, the present invention provides oligomeric compounds including oligonucleotides of any of a variety of ranges of lengths. In certain embodiments, the invention provides oligomeric compounds or oligonucleotides consisting of X to Y linked nucleosides, where X represents the fewest number of nucleosides in the range and Y represents the largest number of nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, the invention provides oligomeric compounds which comprise oligonucleotides consisting of 8 to 9, 8 to 10, 8 to 11, 8 to 12, 8 to 13, 8 to 14, 8 to 15, 8 to 16, 8 to 17, 8 to 18, 8 to 19, 8 to 20, 8 to 21, 8 to 22, 8 to 23, 8 to 24, 8 to 25, 8 to 26, 8 to 27, 8 to 28, 8 to 29, 8 to 30, 9 to 10, 9 to 11, 9 to 12, 9 to 13, 9 to 14, 9 to 15, 9 to 16, 9 to 17, 9 to 18, 9 to 19, 9 to 20, 9 to 21, 9 to 22, 9 to 23, 9 to 24, 9 to 25, 9 to 26, 9 to 27, 9 to 28, 9 to 29, 9 to 30, 10 to 11, 10 to 12, 10 to 13, 10 to 14, 10 to 15, 10 to 16, 10 to 17, 10 to 18, 10 to 19, 10 to 20, 10 to 21, 10 to 22, 10 to 23, 10 to 24, 10 to 25, 10 to 26, 10 to 27, 10 to 28, 10 to 29, 10 to 30, 11 to 12, 11 to 13, 11 to 14, 11 to 15, 11 to 16, 11 to 17, 11 to 18, 11 to 19, 11 to 20, 11 to 21, 11 to 22, 11 to 23, 11 to 24, 11 to 25, 11 to 26, 11 to 27, 11 to 28, 11 to 29, 11 to 30, 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides. In embodiments where the number of nucleosides of an oligomeric compound or oligonucleotide is limited, whether to a range or to a specific number, the oligomeric compound or oligonucleotide may, nonetheless further comprise additional other substituents. For example, an oligonucleotide comprising 8-30 nucleosides excludes oligonucleotides having 31 nucleosides, but, unless otherwise indicated, such an oligonucleotide may further comprise, for example one or more conjugates, terminal groups, or other substituents. In certain embodiments, a gapmer oligonucleotide has any of the above lengths.

One of skill in the art will appreciate that certain lengths may not be possible for certain motifs. For example: a gapmer having a 5'-wing region consisting of four nucleotides, a gap consisting of at least six nucleotides, and a 3'-wing region consisting of three nucleotides cannot have an overall length less than 13 nucleotides. Thus, one would understand that the lower length limit is 13 and that the limit of 10 in "10-20" has no effect in that embodiment.

Further, where an oligonucleotide is described by an overall length range and by regions having specified lengths, and where the sum of specified lengths of the regions is less than the upper limit of the overall length range, the oligonucleotide may have additional nucleosides, beyond those of the specified regions, provided that the total number of nucleosides does not exceed the upper limit of the overall length range. For example, an oligonucleotide consisting of 20-25 linked nucleosides comprising a 5'-wing consisting of 5 linked nucleosides; a 3'-wing consisting of 5 linked nucleosides and a central gap consisting of 10 linked nucleosides (5+5+10=20) may have up to 5 nucleosides that are not part of the 5'-wing, the 3'-wing, or the gap (before reaching the overall length limitation of 25). Such additional nucleosides may be 5' of the 5'-wing and/or 3' of the 3' wing.

Certain Oligonucleotides

In certain embodiments, oligonucleotides of the present invention are characterized by their sugar motif, internucleoside linkage motif, nucleobase modification motif and overall length. In certain embodiments, such parameters are each independent of one another. Thus, each internucleoside linkage of an oligonucleotide having a gapmer sugar motif may be modified or unmodified and may or may not follow the gapmer modification pattern of the sugar modifications. Thus, the internucleoside linkages within the wing regions of a sugar-gapmer may be the same or different from one another and may be the same or different from the internucleoside linkages of the gap region. Likewise, such sugar-gapmer oligonucleotides may comprise one or more modified nucleobase independent of the gapmer pattern of the sugar modifications. Herein if a description of an oligonucleotide or oligomeric compound is silent with respect to one or more parameter, such parameter is not limited. Thus, an oligomeric compound described only as having a gapmer sugar motif without further description may have any length, internucleoside linkage motif, and nucleobase modification motif. Unless otherwise indicated, all chemical modifications are independent of nucleobase sequence.

Certain Conjugate Groups

In certain embodiments, oligomeric compounds are modified by attachment of one or more conjugate groups. In general, conjugate groups modify one or more properties of the attached oligomeric compound including but not limited to pharmacodynamics, pharmacokinetics, stability, binding, absorption, cellular distribution, cellular uptake, charge and clearance. Conjugate groups are routinely used in the chemical arts and are linked directly or via an optional conjugate linking moiety or conjugate linking group to a parent compound such as an oligomeric compound, such as an oligonucleotide. Conjugate groups includes without limitation, intercalators, reporter molecules, polyamines, polyamides, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins and dyes. Certain conjugate groups have been described previously, for example: cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al., Ann. N.Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., do-decan-diol or undecyl residues (Saison-Behmoaras et al., EMBO J., 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-oxy-cholesterol moiety (Crooke et al., J. Pharmacol. Exp. Ther., 1996, 277, 923-937).

In certain embodiments, a conjugate group comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, flufenamic acid, folinic acid, a benzothiadiazide, chlorothiazide, a diazepine, indo-methicin, a barbiturate, a cephalosporin, a sulfa drug, an antidiabetic, an antibacterial or an antibiotic.

In certain embodiments, conjugate groups are directly attached to oligonucleotides in oligomeric compounds. In certain embodiments, conjugate groups are attached to oligonucleotides by a conjugate linking group. In certain such embodiments, conjugate linking groups, including, but not limited to, bifunctional linking moieties such as those known in the art are amenable to the compounds provided herein. Conjugate linking groups are useful for attachment of conjugate groups, such as chemical stabilizing groups, functional groups, reporter groups and other groups to selective sites in a parent compound such as for example an oligomeric compound. In general a bifunctional linking moiety comprises a hydrocarbyl moiety having two functional groups. One of the functional groups is selected to bind to a parent molecule or compound of interest and the other is selected to bind essentially any selected group such as chemical functional group or a conjugate group. In some embodiments, the conjugate linker comprises a chain structure or an oligomer of repeating units such as ethylene glycol or amino acid units. Examples of functional groups that are routinely used in a bifunctional linking moiety include, but are not limited to, electrophiles for reacting with nucleophilic groups and nucleophiles for reacting with electrophilic groups. In some embodiments, bifunctional linking moieties include amino, hydroxyl, carboxylic acid, thiol, unsaturations (e.g., double or triple bonds), and the like.

Some nonlimiting examples of conjugate linking moieties include pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other linking groups include, but are not limited to, substituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

Conjugate groups may be attached to either or both ends of an oligonucleotide (terminal conjugate groups) and/or at any internal position.

In certain embodiments, conjugate groups are at the 3'-end of an oligonucleotide of an oligomeric compound. In certain embodiments, conjugate groups are near the 3'-end. In certain embodiments, conjugates are attached at the 3'end of an oligomeric compound, but before one or more terminal group nucleosides. In certain embodiments, conjugate groups are placed within a terminal group.

In certain embodiments, the present invention provides oligomeric compounds. In certain embodiments, oligomeric compounds comprise an oligonucleotide. In certain embodiments, an oligomeric compound comprises an oligonucleotide and one or more conjugate and/or terminal groups. Such conjugate and/or terminal groups may be added to oligonucleotides having any of the chemical motifs discussed above. Thus, for example, an oligomeric compound comprising an oligonucleotide having region of alternating nucleosides may comprise a terminal group.

Antisense Compounds

In certain embodiments, oligomeric compounds of the present invention are antisense compounds. Such antisense compounds are capable of hybridizing to a target nucleic acid, resulting in at least one antisense activity. In certain embodiments, antisense compounds specifically hybridize to one or more target nucleic acid. In certain embodiments, a specifically hybridizing antisense compound has a nucleobase sequence comprising a region having sufficient complementarity to a target nucleic acid to allow hybridization and result in antisense activity and insufficient complementarity to any non-target so as to avoid non-specific hybridization to any non-target nucleic acid sequences under conditions in which specific hybridization is desired (e.g., under physiological conditions for in vivo or therapeutic uses, and under conditions in which assays are performed in the case of in vitro assays).

In certain embodiments, the present invention provides antisense compounds comprising oligonucleotides that are fully complementary to the target nucleic acid over the entire length of the oligonucleotide. In certain embodiments, oligonucleotides are 99% complementary to the target nucleic acid. In certain embodiments, oligonucleotides are 95% complementary to the target nucleic acid. In certain embodiments, such oligonucleotides are 90% complementary to the target nucleic acid.

In certain embodiments, such oligonucleotides are 85% complementary to the target nucleic acid. In certain embodiments, such oligonucleotides are 80% complementary to the target nucleic acid. In certain embodiments, an antisense compound comprises a region that is fully complementary to a target nucleic acid and is at least 80% complementary to the target nucleic acid over the entire length of the oligonucleotide. In certain such embodiments, the region of full complementarity is from 6 to 14 nucleobases in length.

In certain embodiments antisense compounds and antisense oligonucleotides comprise single-strand compounds. In certain embodiments antisense compounds and antisense oligonucleotides comprise double-strand compounds.

Certain Target Nucleic Acids and Mechanisms

Amyloid precursor protein (APP) is an integral membrane protein that is the precursor protein for beta amyloid (Aβ). Proteolytic cleavage of APP generates Aβ, and Aβ is the primary component of senile plaques associated with Alzheimer's Disease. In certain embodiments, APP contains several proteolytic cleavage sites that, when cleaved by a protease (for example γ-secretase) produce Aβ. APP cleavage can also produce Aβ42, a longer form of Aβ that is more prone to aggregation and is associated with neurotoxic amyloid formation. Accordingly, reducing Aβ production or preventing Aβ formation from APP can delay or prevent the formation of senile plaques caused by aggregation of Aβ. Also, reducing Aβ42 production or preventing Aβ42 formation from APP can delay or prevent the formation of senile plaques caused by aggregation of Aβ42.

The present disclosure provides compounds and methods for reducing Aβ expression. In certain embodiments, modified oligonucleotides targeted to the APP transcript modulates splicing of APP in a manner that prevents the formation of Aβ. In certain embodiments, modified oligonucleotides targeted to the APP transcript modulates splicing of APP in a manner that prevents the formation of Aβ42. For example, the present disclosure provides modified oligonucleotides targeted to APP that block exon 17 splicing. Surprisingly, blocking exon 17 splicing induces the production of an alternatively spliced APP mRNA isoform that lacks 49 amino acids. These 49 amino acids include the γ-secretase cleavage sites on APP that, when cleaved, give rise to toxic Alzheimer's Disease associated Aβ, including Aβ42.

In certain embodiments, modified oligonucleotides disclosed herein reduce the inclusion of exon 17 in APP mRNA. In certain embodiments, modified oligonucleotides disclosed herein reduce the amount of Aβ. In certain embodiments, modified oligonucleotides disclosed herein prevent the formation of Aβ. In certain embodiments, modified oligonucleotides disclosed herein reduce the amount of Aβ42. In certain embodiments, modified oligonucleotides disclosed herein prevent the formation of Aβ42.

In certain embodiments, an antisense compound comprises a modified oligonucleotide consisting of 8 to 30 linked nucleosides and having a nucleobase sequence comprising a complementary region comprising at least 8 contiguous nucleobases complementary to a target region of equal length of an APP transcript. In certain embodiments, the target region is within nucleobase 282118 and nucleobase 282310 of SEQ ID NO.: 1. In certain embodiments, the target region is within nucleobase 282128 and nucleobase 282150 of SEQ ID NO.: 1.

Certain embodiments provide a compound comprising a modified oligonucleotide comprising of the nucleobase sequence of any one of SEQ ID NOs: 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, or 42. Certain embodiments provide a compound comprising a modified oligonucleotide consisting of the nucleobase sequence of any one of SEQ ID NOs: 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, or 42.

Certain Pharmaceutical Compositions

In certain embodiments, the present invention provides pharmaceutical compositions comprising one or more antisense compound. In certain embodiments, such pharmaceutical composition comprises a suitable pharmaceutically acceptable diluent or carrier. In certain embodiments, a pharmaceutical composition comprises a sterile saline solution and one or more antisense compound. In certain embodiments, such pharmaceutical composition consists of a sterile saline solution and one or more antisense compound. In certain embodiments, the sterile saline is pharmaceutical grade saline. In certain embodiments, a pharmaceutical composition comprises one or more antisense compound and sterile water. In certain embodiments, a pharmaceutical composition consists of one or more antisense compound and sterile water. In certain embodiments, the sterile saline is pharmaceutical grade water. In certain embodiments, a pharmaceutical composition comprises one or more antisense compound and phosphate-buffered saline (PBS). In certain embodiments, a pharmaceutical composition consists of one or more antisense compound and sterile phosphate-buffered saline (PBS). In certain embodiments, the sterile saline is pharmaceutical grade PBS.

In certain embodiments, antisense compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

Pharmaceutical compositions comprising antisense compounds encompass any pharmaceutically acceptable salts, esters, or salts of such esters. In certain embodiments, pharmaceutical compositions comprising antisense compounds comprise one or more oligonucleotide which, upon administration to an animal, including a human, is capable of providing (directly or indirectly) the biologically active metabolite or residue thereof. Accordingly, for example, the disclosure is also drawn to pharmaceutically acceptable salts of antisense compounds, prodrugs, pharmaceutically acceptable salts of such prodrugs, and other bioequivalents. Suitable pharmaceutically acceptable salts include, but are not limited to, sodium and potassium salts.

A prodrug can include the incorporation of additional nucleosides at one or both ends of an oligomeric compound which are cleaved by endogenous nucleases within the body, to form the active antisense oligomeric compound.

Lipid moieties have been used in nucleic acid therapies in a variety of methods. In certain such methods, the nucleic acid is introduced into preformed liposomes or lipoplexes made of mixtures of cationic lipids and neutral lipids. In certain methods, DNA complexes with mono- or polycationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions provided herein comprise one or more modified oligonucleotides and one or more excipients. In certain such embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, a pharmaceutical composition provided herein comprises a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, a pharmaceutical composition provided herein comprises one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, a pharmaceutical composition provided herein comprises a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, a pharmaceutical composition provided herein is prepared for oral administration. In certain embodiments, pharmaceutical compositions are prepared for buccal administration.

In certain embodiments, a pharmaceutical composition is prepared for administration by injection (e.g., intravenous, subcutaneous, intramuscular, etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes. Aqueous injection suspensions may contain substances that increase the viscosity of the suspension, such as sodium carboxymethyl cellulose, sorbitol, or dextran. Optionally, such suspensions may also contain suitable stabilizers or agents that increase the solubility of the pharmaceutical agents to allow for the preparation of highly concentrated solutions.

In certain embodiments, a pharmaceutical composition is prepared for transmucosal administration. In certain of such embodiments penetrants appropriate to the barrier to be permeated are used in the formulation. Such penetrants are generally known in the art.

In certain embodiments, a pharmaceutical composition provided herein comprises an oligonucleotide in a therapeutically effective amount. In certain embodiments, the therapeutically effective amount is sufficient to prevent, alleviate or ameliorate symptoms of a disease or to prolong the survival of the subject being treated. Determination of a therapeutically effective amount is well within the capability of those skilled in the art.

In certain embodiments, one or more modified oligonucleotide provided herein is formulated as a prodrug. In certain embodiments, upon in vivo administration, a prodrug is chemically converted to the biologically, pharmaceutically or therapeutically more active form of an oligonucleotide. In certain embodiments, prodrugs are useful because they are easier to administer than the corresponding active form. For example, in certain instances, a prodrug may be more bioavailable (e.g., through oral administration) than is the corresponding active form. In certain instances, a prodrug may have improved solubility compared to the corresponding active form. In certain embodiments, prodrugs are less water soluble than the corresponding active form. In certain instances, such prodrugs possess superior transmittal across cell membranes, where water solubility is detrimental to mobility. In certain embodiments, a prodrug is an ester. In certain such embodiments, the ester is metabolically hydrolyzed to carboxylic acid upon administration. In certain instances the carboxylic acid containing compound is the corresponding active form. In certain embodiments, a prodrug comprises a short peptide (polyaminoacid) bound to an acid group. In certain of such embodiments, the peptide is cleaved upon administration to form the corresponding active form.

In certain embodiments, the present invention provides compositions and methods for reducing the amount or activity of a target nucleic acid in a cell. In certain embodiments, the cell is in an animal. In certain embodiments, the animal is a mammal. In certain embodiments, the animal is a rodent. In certain embodiments, the animal is a primate. In certain embodiments, the animal is a non-human primate. In certain embodiments, the animal is a human.

In certain embodiments, the present invention provides methods of administering a pharmaceutical composition comprising an oligomeric compound of the present invention to an animal. Suitable administration routes include, but are not limited to, oral, rectal, transmucosal, intestinal, enteral, topical, suppository, through inhalation, intrathecal, intracerebroventricular, intraperitoneal, intranasal, intraocular, intratumoral, and parenteral (e.g., intravenous, intramuscular, intramedullary, and subcutaneous). In certain embodiments, pharmaceutical intrathecals are administered to achieve local rather than systemic exposures. For example, pharmaceutical compositions may be injected directly in the area of desired effect (e.g., into the eyes, ears).

Nonlimiting Disclosure and Incorporation by Reference

While certain compounds, compositions and methods described herein have been described with specificity in accordance with certain embodiments, the following examples serve only to illustrate the compounds described herein and are not intended to limit the same. Each of the references, GenBank accession numbers, and the like recited herein is hereby incorporated by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH for the natural 2'-H of DNA) or as an RNA having a modified base (thymine (methylated uracil) for natural uracil of RNA).

Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other unmodified bases, such as "AT$^{me}$CGAUCG," wherein $^{me}$C indicates a cytosine base comprising a methyl group at the 5-position.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif And, for example, where a particular high-affinity modification appears at a particular position, other high-affinity modifications at the same position are considered suitable, unless otherwise indicated.

Example 1 Exon 17 Skipping in HEK293T Cells

Modified oligonucleotides were synthesized using standard methods well known in the art. The compounds in the table below are full 2'-O-methoxyethyl (2'-MOE) 18-mer oligonucleotides with phosphorothioate linkages at each position. The compounds are complementary to the pre-mRNA for hAPP, the complement of GENBANK NC_000021.9, truncated from 25878001 to 26174000 (SEQ ID NO: 1).

HEK293T were transfected with the hAPP pCMV-AIP expression plasmid, which has been described in detail (Sing, et al., "Targeting BACE1 with siRNAs ameliorates Alzheimer disease neuropathology in a transgenic model" *Nature neuroscience* 8, 1343-1349, 2005). Briefly, this plasmid co-expresses human APP with Swedish/Indiana mutations and a mutated form of presenilin (PS1DelE9) from a CMV promoter, and produces both proteins through the use of an IRES sequence. Modified oligonucleotides were transfected using electroporation at a final concentration of 100 nM. Cells were collected in Trizol (Life Technologies) 48 hours after transfection and RNA was isolated per manufacturer's instructions. cDNA was generated using 1 μg total RNA and GoScript Reverse Transcription System (Promega). Splicing was analyzed by radiolabeled PCR of cDNA using GoTaq Green (Promega) supplemented with α-32P-dCTP and primers Human APP exon 14F (CCAGC-CAACACAGAAAACGAAG, SEQ ID NO: 3) and Human APP exon 18R (CTAGTTCTGCATCTGCTCAAAGAAC, SEQ ID NO: 4) flanking APP exon 15 and exon 18. Reaction products were run on a 6% non-denaturing polyacrylamide gel and quantified using a Typhoon 7000 phosphorimager (GE Healthcare). Percentage exon-skipped product is calculated from the intensity of the band for Δ17 product divided by total intensity (Δ17+full length) on the gel.

TABLE 1

Modified oligonucleotides and Exon-17 skipping

| Compound ID | Sequence | SEQ ID 1 Start site | SEQ ID 1 Stop site | SEQ ID NO | % Exon-skipped product |
|---|---|---|---|---|---|
| none | n/a | n/a | n/a | n/a | 2 |
| PBS | n/a | n/a | n/a | n/a | 2 |
| 649949 | CACCTTGAAAACAAATTA | 282118 | 282135 | 7 | 2 |
| 649950 | AAGAACACCTTGAAAACA | 282123 | 282140 | 8 | 5 |
| 649951 | CTGCAAAGAACACCTTGA | 282128 | 282145 | 9 | 59 |
| 649952 | ATCTTCTGCAAAGAACAC | 282133 | 282150 | 10 | 48 |
| 649953 | CCCACATCTTCTGCAAAG | 282138 | 282155 | 11 | 4 |
| 649954 | TTGAACCCACATCTTCTG | 282143 | 282160 | 12 | 2 |
| 649955 | TTTGTTTGAACCCACATC | 282148 | 282165 | 13 | 3 |
| 649956 | GCACCTTTGTTTGAACCC | 282153 | 282170 | 14 | 9 |
| 649957 | TGATTGCACCTTTGTTTG | 282158 | 282175 | 15 | 3 |
| 649958 | TCCAATGATTGCACCTTT | 282163 | 282180 | 16 | 2 |
| 649959 | ATGAGTCCAATGATTGCA | 282168 | 282185 | 17 | 3 |
| 649960 | CCACCATGAGTCCAATGA | 282173 | 282190 | 18 | 2 |
| 649961 | ACCGCCCACCATGAGTCC | 282178 | 282195 | 19 | 9 |
| 649962 | ACAACACCGCCCACCATG | 282183 | 282200 | 20 | 8 |
| 649963 | CTATGACAACACCGCCCA | 282188 | 282205 | 21 | 2 |
| 649964 | TGTCGCTATGACAACACC | 282193 | 282210 | 22 | 2 |
| 649965 | ATCACTGTCGCTATGACA | 282198 | 282215 | 23 | 2 |

TABLE 1-continued

Modified oligonucleotides and Exon-17 skipping

| Compound ID | Sequence | SEQ ID 1 Start site | SEQ ID 1 Stop site | SEQ ID NO | % Exon-skipped product |
|---|---|---|---|---|---|
| 649966 | TGACGATCACTGTCGCTA | 282203 | 282220 | 24 | 2 |
| 649967 | GGTGATGACGATCACTGT | 282208 | 282225 | 25 | 3 |
| 649968 | ACCAAGGTGATGACGATC | 282213 | 282230 | 26 | 2 |
| 649969 | GCATCACCAAGGTGATGA | 282218 | 282235 | 27 | 2 |
| 649970 | CTTCAGCATCACCAAGGT | 282223 | 282240 | 28 | 2 |
| 649971 | TTCTTCTTCAGCATCACC | 282228 | 282245 | 29 | 4 |
| 649972 | ACTGTTTCTTCTTCAGCA | 282233 | 282250 | 30 | 3 |
| 649973 | TGTGTACTGTTTCTTCTT | 282238 | 282255 | 31 | 4 |
| 649974 | ATGGATGTGTACTGTTTC | 282243 | 282260 | 32 | 4 |
| 649975 | GATGAATGGATGTGTACT | 282248 | 282265 | 33 | 4 |
| 649976 | ACCATGATGAATGGATGT | 282253 | 282270 | 34 | 8 |
| 649977 | ACCACACCATGATGAATG | 282258 | 282275 | 35 | 3 |
| 649978 | CCTCCACCACACCATGAT | 282263 | 282280 | 36 | 3 |
| 649979 | ACCTACCTCCACCACACC | 282268 | 282285 | 37 | 3 |
| 649980 | AGTTTACCTACCTCCACC | 282273 | 282290 | 38 | 3 |
| 649981 | AGTCAAGTTTACCTACCT | 282278 | 282295 | 39 | 13 |
| 649982 | CATGCAGTCAAGTTTACC | 282283 | 282300 | 40 | 3 |
| 649983 | GGAAACATGCAGTCAAGT | 282288 | 282305 | 41 | 2 |
| 649984 | CACTTGGAAACATGCAGT | 282293 | 282310 | 42 | 2 |

Example 2 Dose Response in HEK293T Cells

HEK293T cells were transfected with the hAPP pCMV-AIP plasmid described in Example 1 and then transfected with 0, 25, 50, 100, 200, or 400 nM of compound 649951 or 649952. RNA was isolated and analyzed as in Example 1.

TABLE 2

Exon-17 Skipping in HEK293T cells

| Compound ID | % Exon-17 Skipping | | | | | | $EC_{50}$ (nM) |
|---|---|---|---|---|---|---|---|
| | 0 nM | 25 nM | 50 nM | 100 nM | 200 nM | 400 nM | |
| 649951 | 0.07 | 13.31 | 21.67 | 39.53 | 37.54 | 43.25 | 43.8 |
| 649952 | 0.02 | 7.37 | 12.64 | 26.36 | 31.20 | 29.31 | 55.3 |

Example 3 Activity in Down's Syndrome Patient Fibroblasts

RT-qPCR was used to analyze hAPP mRNA in Down's Syndrome (DS) cell lines (GM02571, GM02767, GM04928, Coriell Cell Repository) and control chromosomally normal fibroblast cell lines (GM03814, GM24590, GM24591, Coriell Cell Repository). Cells were cultured in 10% FBS DMEM and RNA was isolated with Trizol per the manufacturer's instructions. RT-qPCR was run with SYBR Green PCR master mix using primer set hAPP ex14F (5'-CCAGC-CAACACAGAAAACGAAG-3' (SEQ ID NO: 3)) and hAPP ex18R (5'-CTAGTTCTGCATCTGCTCAAAGAAC-3'(SEQ ID NO: 4)) and values were normalized to human β-actin, detected using primers hACTB F (5'-AAA-GACCTGTACGCCAACAC-3' (SEQ ID NO: 77)) and hACTB R (5'-GTCATACTCCTGCTTGCTGAT-3' (SEQ ID NO: 78)).

TABLE 3

Expression of hAPP in DS fibroblasts

| Cell lines | Relative hAPP mRNA |
|---|---|
| DS | 2.49 |
| normal | 1.13 |

Compound 649951 was transfected at 50 nM concentration into DS fibroblast cell lines and control chromosomally normal fibroblast cell lines. Cells were transfected using Lipofectamine 2000 (Life Technologies).

Exon skipping was analyzed as in Example 1. Data represents the average of activity in the three DS cell lines.

TABLE 4

| Exon-17 skipping in DS cell lines | |
|---|---|
| Concentration 649951 (nM) | % Exon-17 Skipped |
| 0 | 2.88 |
| 6.25 | 7.27 |
| 12.5 | 30.39 |
| 25 | 49.15 |
| 50 | 60.85 |
| 100 | 54.64 |

The amount of Aβ42 secreted from cells was analyzed by ELISA using a Human/Rat β-Amyloid kit (Wako) per the manufacturer's instructions. Cells were transfected with 50 nM of control single stranded oligonucleotide 439272, a uniform 2'-methoxyethyl modified oligonucleotide with a full phosphorothioate backbone with sequence TTAGTT-TAATCACGCTCG (SEQ ID NO: 76) or 649951 or were untreated for 48 hours, and then cultured in Opti-Mem media for 5 days prior to collection of the supernatant for analysis.

TABLE 5

| Aβ42 levels in DS cell lines | | |
|---|---|---|
| Cell Line | Treatment | Aβ42 (pM) |
| Control | None | 5.4 |
| DS | Control 439272 | 15.7 |
| DS | 649951 | 8.7 |

Example 4 Exon 15 Skipping in a Mouse Cell Line

To test whether modified oligonucleotides targeting APP splicing can lower Aβ in vivo, first, modified oligonucleotides were designed to target the murine APP exon 15, which is homologous to human APP exon 17. Modified oligonucleotides were screened for activity in vitro in a mouse primary kidney cell line (208ee, described in Lentz, et. al., "Rescue of hearing and vestibular function by antisense oligonucleotides in a mouse model of human deafness." Nature medicine 19, 345-350, 2013).

Splicing was analyzed as described in Example 1 using primers Mouse APP exon 14F (AGACG-GAAGAGATCTCGG, SEQ ID NO: 5) and Mouse APP exon 16R (GGTCACGGCGGCGTCGAC, SEQ ID NO: 6). Reaction products were run on 6% non-denaturing polyacrylamide gel and quantified using a Typhoon 7000 phosphorimager (GE Healthcare). Percentage exon-skipped product is calculated from the intensity of the band for Δ15 product divided by total intensity (Δ15+full length) on the gel.

The compounds in the table below are full 2'-O-methoxyethyl (2'-MOE) 18-mer oligonucleotides with phosphorothioate linkages at each position. The compounds are complementary to the pre-mRNA for mouse APP, the complement of GENBANK NC_000082.6, truncated from 84951001 to 85177000 (SEQ ID NO: 2).

TABLE 6

| Exon-15 Skipping in mouse primary kidney cells | | | | | |
|---|---|---|---|---|---|
| Compound ID | Sequence | SEQ ID 1 Start site | SEQ ID 1 Stop site | SEQ ID NO | % Skipping Exon 15 |
| none | n/a | n/a | n/a | n/a | 0 |
| 752456 | CACCTTCGAAAGGAAGCC | 214118 | 214135 | 43 | 3 |
| 752457 | AAGAACACCTTCGAAAGG | 214123 | 214140 | 44 | 3 |
| 752458 | CAGCAAAGAACACCTTCG | 214128 | 214145 | 45 | 26 |
| 752459 | ATCTTCAGCAAAGAACAC | 214133 | 214150 | 46 | 26 |
| 752460 | CCCACATCTTCAGCAAAG | 214138 | 214155 | 47 | 0 |
| 752461 | TCGAACCCACATCTTCAG | 214143 | 214160 | 48 | 8 |
| 752462 | TTTGTTCGAACCCACATC | 214148 | 214165 | 49 | 1 |
| 752463 | GCGCCTTTGTTCGAACCC | 214153 | 214170 | 50 | 0 |
| 752464 | TGATGGCGCCTTTGTTCG | 214158 | 214175 | 51 | 3 |
| 752465 | TCCGATGATGGCGCCTTT | 214163 | 214180 | 52 | 1 |
| 752466 | ATGAGTCCGATGATGGCG | 214168 | 214185 | 53 | 22 |
| 752467 | CCACCATGAGTCCGATGA | 214173 | 214190 | 54 | 8 |
| 752468 | GCCGCCCACCATGAGTCC | 214178 | 214195 | 55 | 0 |
| 752469 | ACAACGCCGCCCACCATG | 214183 | 214200 | 56 | 0 |
| 752470 | CTATGACAACGCCGCCCA | 214188 | 214205 | 57 | 0 |
| 752471 | GGTTGCTATGACAACGCC | 214193 | 214210 | 58 | 0 |

TABLE 6-continued

Exon-15 Skipping in mouse primary kidney cells

| Compound ID | Sequence | SEQ ID 1 Start site | SEQ ID 1 Stop site | SEQ ID NO | % Skipping Exon 15 |
|---|---|---|---|---|---|
| 752472 | ATCACGGTTGCTATGACA | 214198 | 214215 | 59 | 2 |
| 752473 | TGACAATCACGGTTGCTA | 214203 | 214220 | 60 | 0 |
| 752474 | GGTGATGACAATCACGGT | 214208 | 214225 | 61 | 0 |
| 752475 | ACCAGGGTGATGACAATC | 214213 | 214230 | 62 | 0 |
| 752476 | ACATCACCAGGGTGATGA | 214218 | 214235 | 63 | 0 |
| 752477 | CTTCAACATCACCAGGGT | 214223 | 214240 | 64 | 0 |
| 752478 | TTCTTCTTCAACATCACC | 214228 | 214245 | 65 | 0 |
| 752479 | ACTGTTTCTTCTTCAACA | 214233 | 214250 | 66 | 0 |
| 752480 | GATGGATGGATGTGTACT | 214248 | 214265 | 67 | 0 |
| 752481 | GCCATGATGGATGGATGT | 214253 | 214270 | 68 | 0 |
| 752482 | ACCACGCCATGATGGATG | 214258 | 214275 | 69 | 0 |
| 752483 | CCTCCACCACGCCATGAT | 214263 | 214280 | 70 | 1 |
| 752484 | ACCTACCTCCACCACGCC | 214268 | 214285 | 71 | 5 |
| 752485 | GGTTTACCTACCTCCACC | 214273 | 214290 | 72 | 7 |
| 752486 | CTCCAGGTTTACCTACCT | 214278 | 214295 | 73 | 46 |
| 752487 | CAAGCCTCCAGGTTTACC | 214283 | 214300 | 74 | 0 |
| 752488 | GCAGACAAGCCTCCAGGT | 214288 | 214305 | 75 | 0 |

Example 5 Dose Response in a Mouse Cell Line

Mouse primary kidney cells (208ee) were transfected with 0, 25, 50, 100, 200, or 400 nM of compound 752458 or 752486. RNA was isolated and analyzed as in Example 1.

TABLE 7

Exon-15 Skipping in mouse primary kidney cells

| | % Exon-17 Skipping | | | | | | |
|---|---|---|---|---|---|---|---|
| Compound ID | 0 nM | 25 nM | 50 nM | 100 nM | 200 nM | 400 nM | $EC_{50}$ (nM) |
| 752458 | 0.08 | 15.54 | 21.26 | 23.69 | 30.36 | 20.70 | 20.5 |
| 752486 | 0.07 | 20.57 | 34.87 | 41.1 | 43.95 | 38.92 | 25.9 |

Example 6 In Vivo Exon-15 Skipping in Neonatal Mice

Wild-type mice were injected with 25 or 50 μg of compound 752486 or 25 μg control oligonucleotide 439272 by intracerebroventricular (ICV) injection on post-natal day 1 or two, and cortex and hippocampal tissue were collected after three weeks. Control group contained 7 mice while the treatment groups contained 9 mice each. RNA was isolated from tissues and analyzed as in Example 4.

TABLE 8

Exon-15 skipping in vivo

| Treatment | % Exon 15 Skipped, cortex | % Exon 15 Skipped, hippocampus |
|---|---|---|
| 25 μg Control 439272 | 0 | 0 |
| 25 μg 752486 | 16.55 | 16.13 |
| 50 μg 752486 | 27.32 | 19.66 |

Example 6 In Vivo Exon 15 Skipping in Adult Mice Treated as Neonates

Wild-type mice were injected with 25 μg of compound 752486 or control oligonucleotide 439272 by intracerebroventricular (ICV) injection on post-natal day 1 or two, and cortex and hippocampal tissue were collected after three months. Data represent an average of 7 mice for compound 752486 and 8 mice for control 439272. RNA was isolated from cortex and hippocampal tissue and analyzed as above. Additionally, Aβ42 levels were analyzed by ELISA as in example 3.

TABLE 9

Exon-15 skipping and Aβ42 in vivo

| Treatment | % Exon 15 Skipped, cortex | Aβ42 (pmol/mg tissue) in hippocampus |
|---|---|---|
| 25 μg Control 439272 | 0.53 | 0.13 |
| 25 μg 752486 | 10.45 | 0.30 |

Example 7 In Vivo Exon 15 Skipping in Mice Treated as Adults

Wild-type mice were injected with 500 μg of compound 752486 or phosphate buffered saline (PBS) by intracerebroventricular (ICV) injection at 2 months of age, and cortex and hippocampal tissue were collected after three weeks. RNA was isolated from tissues and analyzed as above. Additionally, Aβ42 levels were analyzed by ELISA as in example 3.

TABLE 10

Exon-15 skipping and Aβ42 in vivo

| Treatment | % Exon 15 Skipped, cortex | Aβ42 (pmol/mg tissue) in hippocampus |
|---|---|---|
| Vehicle control (saline) | 0.50 | 0.15 |
| 500 μg 752486 | 15.13 | 0.015 |

Example 8 In Vivo Exon 17 Skipping in Mice Treated as Adults

Neonatal (1 day old) hemizygous R1.40 mice (transgenic for human BAC-APP with Swedish mutation) were injected with 50 μg of compound 649951 (described above) or 50 μg of compound 649952 (described above) or phosphate buffered saline (PBS) by intracerebroventricular (ICV) injection. Additionally, a group of R1.40 mice were injected with 25 μg of compound 649951 or 25 μg of compound 649952. For each group of mice cortex and hippocampal tissue were collected for analysis. RNA was isolated from the tissues and analyzed by RT-PCR as above. The results are shown in the table below.

TABLE 11

Exon-17 skipping in vivo

| Treatment | % Exon 17 Skipped, cortex | % Exon 17 Skipped, hippocampus |
|---|---|---|
| Vehicle control (saline) | 0.0 | 0.0 |
| 50 μg 649951 | 3.7 | 3.2 |
| 50 μg 649952 | 4.3 | 3.5 |
| 25 μg 649951 + 25 μg 649952 | 3.4 | 4.2 |

SEQUENCE LISTING (78 sequences)

SEQ ID NO: 1 - DNA, 296000 bp, Homo sapiens
gtactgtaaaaagacacagacaagccagaacacatttagagaatggccaaggtgtggaaggaaccagaaaccatgccattatgcaactgttgaaggaagtgcctgttttaccttgtgaagagaagactctagaggaagaagtagcatgaaaaccgctggcaaatttgtaaagatctgaagtgtggaaaagaattattctgcttggtcactggggatacaaggatatctgagtgggagtttaaaggcgggggatgtgagctttaaatgggataagaacattctagtaaccagaaatgcccaaagatagaatgcacagtctggagagccagtgaatatctcacaaatggagacacttgaaactaggatggggatgctgttgtaggaattccagcagacaagtggttgttggttccttccccaactttgtagggttataactagggatgttcctgcgttttctgcttggaggatctgcaagacacctcagggcaggaaatggcattaaatgcagaacagagctagtggctgaaaagcaaaaagccatcaggatctctgagtagtgaaggaaccagagaacatgcaggcaatgtccatcattctgacgcaatcagcagcataatcatcttcccccaggaacatcttgaccagggaatgtgtcagtgtggtgaatttcaacagtggaaagagaaactgctaaatctaagaactttaatttttatagattatgatctcatctctacaattttgaatttcatgctcaataaaagttccttactctctttttttttttttgagacggagtctcgctctgtcgcccaggctggagtgcagtggcgcgatctcggctcacttcaagctcagcctcccgggttcacgccattctcctgcctcagcctccccagtagctgggactacaggcgcccgccacgacgcccggctaattttttgtatttttagtagagacggggtttcaccgtgttagccaggatggtgttgatctcctgacctcgtgatccgcccgcctcagcctcccaaagaaaagtccctcactcttaaagttgcctcctccttcccagggctggcttcatgggcatgcaaccctggagagtctcacaggccctgcggtgggaggagccccatgcttggtttaacgctctgccattgccatcttaaaattcttaatttaattttttttcttttttttgaggtggagtctcgctctgtcgcccaggctggagtgcaatggcacaatcttggctcactgcaacctccgcctcccaggttcaagcgattctcctgcctcagcctctggagtagctgggattacaggcaggagtaaccacgctcggctaatttttgcatttttagtagagatgggggtttcaccatgttggccaggctggtctagaactcctgacctcaggtgatctgcccacctgggcctcctaaagtgctgggattacaggcatgagccaccaggcccggccttaaaattcttaataatgtaacaaagggtctcacgtttgcattttgcagtggactctgcaagatttgtagctttggaccacgtttctctttgcattcagataccttcttttttgccttatttgctcatgcagacccggaacaaatacggaattgcggtgggtaaatgtggtgcagaaagtgaacaactgggtttgtcctgtcactttaggcttttccctgctgtcccagcttcatgtcacttacttgctattagatttgggagttcattagcttcattttcctgatgtataaataggaataatagtaacagcctctttggcttttgtaggaagtaaatgacatgaagcgtataaacaaatactgcatgacaataaatatttgtccttatttgttgaggacatccaaaggacattcaggggcaaaagtaatccaagagtcaagactgaatgcctagtgcgggaaaagacacacaagacaacatttaggggagctggtacagaaatgacttcccaggaaggaagtctgtaccccgctggctgagccatccttcccgggcctaggcacccttgtcagcgcaatgagcaagggagagaaggcaggctgcagtgcagccctcagaagggccagagcactccctggcttcagtccttcgctccaagccctgtgtggagtgggctgtggcttggtaactaaatgctacttcaggtcaagagcaggggatatatctgggcagttctagagcattctaaactatctggacactaactggacagtggacggtttgtgtttaatccaggagaaagtggcatggcagaaggttcatttctataattcaggacagacacaatgaagaacaagggcagcgtttgaggtcagaagtcctcatttacgggggtcgaatacgaatgatctctcctaatttttccttcttccccaactcagatggatgttacatccctgcttaacaacaaaaaaagaccccccgccccgcaaaatccacactgaccaccccctttaacaaaacaaaaccaaaaacaaacaaaaatataagaaagaaacaaaacccaagcccagaaccctgctttcaagaagaagtaaatgggttggccgcttctttgccaggtcctgcgccttgctcctttggttcgttctaaagatagaaattccaggttgctcgtgcctgcttttgacgttgggggttaaaaaatgaggttttgctgtctcaacaagcaaagaaaatcctatttcctttaagcttcactcgttctcattctcttccagaaacgcctgccccacctctccaaaccgagagaaaaaacgaaatgcggataaaaacgcaccctagcagcagtcctttatacgacacccccgggaggcctgcggggtcggatgattcaagctcacggggacgagcaggagcgctctcgacttttctagagcctcagcgtcctaggactcacctttccctgatcctgcaccgtccctctcctggccccagactctccctcccactgttcacgaagcccaggtgggccgtcggccggggagcggagggggcgcgtggggtgcaggcggcgccaagggcgcgtgcacctgtgggcgcggggcgcgagggcccctcccggcgcgagcgggcgcagttccccggcggcgccgctaggggtctctctcgggtgccgagcggggtgggccggatcagctgactcgcctggctctgagccccgccgccgcgctcgggctccgtcagtttcctcggcagcggtaggcgagagcacgcggaggagcgtgcgcgggggccccgggagacggcggcggtggcggcgcgggcagagcaaggacgcggcggatcccactcgcacagcagcgcactcggtgccccgcgcagggtcgcgatgctgcccggtttggcactgctcctgctggccgcctggacggctcgggcgctggaggtgggtgccgcgcctcggaaggcggggggaggctgcacggtggggacgcgataccccccaagaccttaacccaagtctttaatgcagagaagccgggggtccgtcaatgggacccctctcctctccgcccccgcttgcggacgtccagcgcatccccgctttcggcccagccctgccccagggagtcgcgctccggcccgctgagagggagcgggcgaggcgctggtctccctggttccgcgccagcccggggcgagaagggtagggggcgaccctgagcccagaccccgacttagtccctgccttggaagcgggggtcgggggaggcgagagacattcagacaggggggaagggggaaggagcacgtggggaaaaccgaaaacgcagcgtccctaaagccagtccttcgctcttgaatcgttgccctttcctttctcttgggccctggggaggaggaggaggagtcgggacagcccaggaagctaggagcccctcgcttttccctgcgttctccgcctcgtttcaccttcctctctcacccccatcccccttccttgctccaacctcttttcgcggctgctggcggcggcagcctgggtgcgaccctagcccgagccggcgtcggggtcgcgcaccgccttccacaggcaaactttgtgcatgtccgcgtctcccttttgtgtaacttgcgagaaatgggaggggtcggagacccatagccaccccgcgccttccccaagtctggacgtcccgggagttcgctcgcaccctaagctctgtctgagaggcagaaggtccgcgggaacaaaagccgcgacaccccgccctcgccgtgggccgagccgcgttagtctcagtgcgccaccgaggctcccgcccggctcccttcccggggctgcgcgtccgcctgggagggggcagagacgctgccggggcttctggcggagcctcggggcccctctgcttcccaccctcggatcacctccgaggcttaattctgtgctgggctgtaaagtccttggcggggaggaaataaggcggagagtgggatgtgcgtctggaaagggcagtggcggatggtggggaggcacgggctctgtcctgtgcatccaaggaggcgtttgtctgattaaggcgcggcctcttccctggcagctctggggactctggtttagttcccctgggggcacaggatgctggggagggtccgaagggtcttttttttagggtgcagataaaaggatcgaattgagtgaagattaagacggagaagatggcgcctctgcagtgcagcaaagaaaagctgtgtggaggctgcagcctagtgaaatccacccaccactaggtgtataacaagtcttccccattcatccaactctcgaacattcagctaacgcctgtgcacaatgactgtttttctttacatctgaagatgcttagaagttgtttgcatgacagttgggccagaggaggctgtatttcacttcggacttcggttgggttcctgtttggcatcttaacatttgcaaccttccttacccgtttttcccctcttttcccccagcctcctagtaattttccaaaagaaaaaaagcaatttccgggcagatgttttcctgtaattccactgaggctgtacagactatcacaccattagttttttagtttctaatttgcaaggtcattgaacttttttctcttctgatttttacccacaagtggctcaggaatcaccttagggctagttaagacaggttgttttaagagttaaagaatttcgttttccatgttttaaaaaaatgcacttaactaagagaattctgatttctctcatgacttacttacatttatttgtagaattattccagttttcccgaatggtcttactacagattaaaaaccatacatttaaggaattaaaagcatatgataaccgtatttttgaagcttttgtcaaaacttaaatatgtaactttgttgagcaatatttctttctgtataaaaagaggaagcatgtaggcagattcgaatttagtttttggtctgtttaattgcattaatatgctctttctgccatcttttgggaccttttcagtagctattgttaactcctttaaagggtggaggtgagattcacattatgccattttgcgaagtgttggtagaagggtaggtaattcagtctactgaggtttgagggtggtttatctggttctctctgtgtccactgaaaagatgtaattacgagttgactgtcttttatagagcttagaaaataggtctgctgcaggtggctgtagaaaagaaatgaataagggcaatgataatggggccttggctatcgggggaaacatggttattatctgggttgatgattttggctggtatgttgatagaggtgtgagtttaacaaaccctaatctatatgatgtttcactaccctaatatttatttatttatttatttttaaatctagcttcctcttaagttttatttccctctgttgagggtttaacctagtcacaatcatcttacctttgtggtagtgctaatttatagtttatggaaacctgctgctactgactagtacctcgctaaaggtagaagccgacacacagaatagtaaagctcaggtttgatggtgatctgtaaggagtcacggttcttgctaatcgatgagaaaccatgataactggcagactgcagaagcttttctcttgtcaccggaaccagcagaggctcctgaacgacatttgcaaggctattagtactgcggagaagttactagatggaataatactggtcctgactgaggaaatgaaaaggaacatgcaagttcacgaggttaaatgaggaatggctgattcaaaaaaattaaaaagaaataacgtgatcaacaatattggtttgaaggaatgggagaggttgtctttatgttaagtcttgttgctagaggatctctattttatgttactgttttttgcatactagagtcttctacagatatttgtatgaatgttgtcagtcattctggaaataagcatagctattacttgcatttcacgtggccactaaactatcagtgagaagtgcattaaattcagtagaaatgtacattgtttctgcaaattgtattaccttgagaatcttacaaagcatctttcattaatacatttcttttaaaatctctatcaattacaaatgtaaagataaacctgtacagatgcattttaaatttaaagcttccagaatgtaaggtttagttcgactgcatacctcattacctccccttccctcctccctccccttactcccaggaagtttgcagggtaaataaaacatgcacatgataataaaacaaagtggaatgtactaaaataccaaaaggaaaatacagattaggtatactgagtaaatatgttacagagaaaacttcctgtatttaaaaagtaaggaacaatgggatgagatcatagataatcctggagcatttcctggtagtaaatttccagccaggtttatatcccaggtctggggattggaggttaagtttctgcatatacaatatttgtttacattcctctctgcctctaccagacagacagacagacacacacacacacacacacacacaccctctgtctctttctctctctttctctctctctctctctctctctctctctctctcacttgagtgacagatgctggtgcagggtattctcaacaggagtagggaatttgaaataaggagttgagaggtcaaaggtaaggggctgaatgcaggaccagagagcttcagtagcatcttgatgggcagagtatgagatgaacagtggcaacgaggaggatagggaaaaatcacattttctgtttgtgttttgtttttgtctggtggttttcaacctctctctgtttcacttgactatgcttgattatgaaatcttttttttttctttttttaatttaaagatctcaactggctttgttgtgattctacattcaggcaacactattctgtaaaatagtataaatgttccgatgagttgaacagaggagattggctttgtagacagaaaagggctgaagaaaacagaaataaaaaaatcttttccttttcatagtgagagctcagatgcaaatgtatggagtggggatggatgggaaatgccgtcttttgcaaacccttggaaacgctgtcaccctgtgggtctcacagccagtgtacagataacaccctcatctgtacacagaagacagaaggtggcaggggaaggaatgagcacaccccagaatgagtagcaagtttaatcaataaaatatgtatttctttttttattgttgtataagaagaaaagcagacagaactcaaaccctgaagctgattttgcaagtgaaaagcttagtaaagggggaaatgttatgtaactattttttcagtttagtgtggatggcttaagaaataatcattactgtgaggacactagtatttttcttggaaaaaaaagtttggcaaattttcctctttagattaatcttggttatagattattattatgcttgagtggtacctcttcagaagtagaaatctggcaaaaactggagtacaatgattgctctaggaataaattcacatatttaaatttaaaagcctggatatgtgcatcaattaatagctttatgaaacagggatgcttagtagattagctagctgagtattcagagagggccacagaagtctcaggttcacatgtattaaatctgctgaaatagaaacctaagagatcattttatttaggtttattttgtgtggctacatgttgaagaaacatgcaatagagatttagcttgaaccttgcgagactcacagtatcttacgaaagaagatagttaaaatggggaagatgagaggtttttaaaaatgtcacctctgtagaacgaaccagagttgttctcaatttataatgttgaatttgatgccaggcgtgatgttaggccaataacactgagtcattgagtgtttctcaggtatgtagagaaggcagcattgcacactaatcaggagagtttagaccagggcaggaatgcatgggcataaattctgtctttgtttcttttgagctagtgaccatgggcaagtttctgtgcctcagttttttcctttgtaaaatgggatgagtacttctagttattgaggatcgaattaatatctttgttaaatgcttgaaacagtgtgtgagttaatatatatgtaacctgatggcatagcataagcactgtgtgttagttgctgctatgtatggtgatgatgttgatgtacaatgggtatatgtaagtttcctgcatagttgaaagttaaaaatctagatgatgtttcacttattgacaaattacttattggccaattaagactattgcaggaaattgacagattgttgtctatgagtttgatctaaatttaaaaagcacatggtatctcagatacaatttttagaatacatgttataaaatttcatttattaaatatgtattgtgtatttcaattggttttttgaaaaatgaaaataattcatgctcattgaaaaatttaaaacagtacagaaatgtgcaaaaagcataagcattttttacacaaatgggaaatacctagtttttttttttctttttttccacataacatggatgtagaccttttttttttttttttgagacagaatctccctctgtcacccaggctggagtgcagtggcgcgatctcggctcactgcaacctccgcctcctgggttcaagcgattctcctgcctcagcctcctgagtagctgggactatgggcactcgccaccatgcccagctaatttttgtattttttaagtagagatggggtttcaccatgttggccaggctggtctcaaactcctgacctcaagtgatctgcccacctcggcctcccagagacctattttttaatgttgtacacactggcagcttgccacagatgtctaatattgagcaagtttatacactggcttgattattaactattagttggctatcagctatgtgcaaggaactgtgaacagacttggtttagttttcagtagaatctttgctagcaaaacgaataaacaggctttgccaatctgggtagaaatggaagatttcaaatgccagcaaaagaattttggtcctaatatggaagcttgaagttatgttcacccaaggacagggaaaccaaaaagcagattgcttgagaatgcggcatttctctaggaaatcagtttcaaaataaaatgaattttttgttttgttttgtttttgagacggagtctcgccctgtcgcccaagctggaatgcagtggtgcgatctcagctcactgcaatctccgcctctcaggttcaagcgattctcctgcctcagcctcccgagtagctgggattacaggcgtgtgccactatgcccagctaatttttatatttttagtagagacggggtttcactatgttggtcaggctggtctcaaactcttgacctcgtgatccgcctgcctcggcctcccaaagtgctgcgattacaggcgtgagccaccgcgcccagctgcagtaaagtgaatttgtgtaaccagccatgttatggctgttacatctttaaaactttatagtgatctgctgtttaattgaaattatatattttttttaaaaatcagcatatgttgctcaaaaataaaaggtttttagcttcaaaagcaggccaaggatatttgaaagccttgagtgtatgaaactggtgatactgtggttaaatgatgatgaacgcagggaaaaatcaagaagcagagtcccaaagaattcacatgggtttttgttaaccagctcatgtaattataattgtcctgtccaactaaagacaagaagacaagaagtgggttcacatacgaggatgtgtaatgacagaagccatatttgtgataaacatcctgattacagtagatacagtgaggagtgattaagatggttccagaagcaggagtggagggttcatgagcagggatgaggaataaataggacaaacattttggaaaagggaaaagatgaataagcctgttttgtaaattaatggatcctgatgaatgaagtgcagtgattccttaaggtcttattaatgatggaccccaaacagtgtttgaatctcttaatttccagatggttcctttttttcttcacaaagtcagaaggttttcttatgagaaatttgattcaacaagaataattgtcacttcttttgttttttggtgatttttttttttttttttttttttttttttgagactgagttttactgtgtcacccaggctggagtgcagtggcgtgtcttggcttactgcaacctctgcctcccgggttcaagcaattctcatgcctcagcctcctgaatagctgggtttacaggcatgtgccaccacgcctggctaatttttgtttttgttttttttttttttagtagagacagggtttcactacattggccagggtggtctcgaactcctgacttcaagtgatccacccacctaggcctcccaaagtgctgggataacaggtgtgagccactgcacctggccaattttttggtgattttgataggaatttttttttttgcctgatgctttttttgagagaatctaataatttgtctcttatttaataatttggctttcattagcttccagaaagccacatactgtcttcattgaaaaatgtaaggcatcctagatgatacagactgataaattacttttcagccataaaagatacttatgagaataagagatctgttgcataaagaaaagtcatttgtgttaagtgaagaaatgcattattactcttgctgctttgctaaatttcaaacattgaataactaatatattttgaccccctggagatattttacaggaagaaaaatgagaggtttaatcctactgttgagatagacttaacgtgttttagacctgcccctcatcccaagttactacaaactcatttgtttagtttttccttgtctgtgtgctcgttatttcacagtaaaattagtgaggcaacataaattttatttttaagagaaagtaaagaaaatggctttatccattaaaggtttattcatcttaaaaaaggacttgttatatctactcctactattggatgaattttcaaaagcatattgatactgtgtttggttttgtttgttttcgggacaagtcctcactctgtcacccaggctgaagtgcagtggtgtgatctgtagccgtggcctcctgggctgaagccatcttcctgccccagcctccagagtagctgggactacaggcatgtgccaccacatctgactaatttcttaaatgttttgtagagatggggtccccactatgttgcccaggctgatcttgaactcctgggctcaagcgatcctcctgcctcgaccttccaaagtgctagattacaggtgtgagctattgtgcctggccaatgttgtttttataaatatcattactcagttattttgtttataattgaattgataggctcatagaataaagatggataagcactgtttcttaactgtatttattgatttttttatctttcaaaaaaaaaatcctcatctacttcaaagattaagcctttaaaaccgatgcaaagtttttgaagtcttagcttaagtcttcagagactaacattaaaacccatcatatgaaaagtgatatgtagtagcaaatattctccatcctgatgctctcaattgcttattatggtttaacacaaatataattttgtcattacagtaaattagtttgaggatataactgaagagtacctaagaaactcccatagaaatgtgaaaatatgcagactaattattctaagaataattaatcatagatacttacatattaaattgattagcaatttaaaattaaagccaaatttctgtggaaattagcttattttcatacacaaagaaacctagattcttaggggtacaaccaagaaagggccactccttcatttcacaaatattttcgaggtccttgcccccaagagggtagacagaataaaaaggaggaaggaagtgacttggaaaaaattaagttgggtaaggaatataagagaatgctacgtagaaggatgtgtgttgtgaatgcaatagtttctgtagtattgtcaaagttctctgatcatttcagtatgtgaaggtaaacttagataactgggggaaggaactatatatttactacattgtaaaagaataattgtagacagaagatctactttgggtgattaaatgttgaaaacaagtggtgggagagagaagttagtgttgattgtgatcacacacttttctatacagtaatttgtttgatcactcatgataatgccttacattttgtatgtactaaataaatgagttctctagaaattctatgttgtggtgataaagaattacgttcagattgaagattcgaacagctgtgcaaccttctcaacatttaagaaactgcgaacaagcatagaaagaagattaaagccttttaaataagattcttttttttcagcctctttttggaacattttattgtgaaaaggtttcataaatactgtcaatacatcacgttcagtcatttgcaattgtatttcaaaaattcagttggcctgcaaaaagaaaaaatgcctcatttttgaaatatttcatccatgccctgattgattgggacactttcaatagagggtgcctagacataattttgtgtgaagaagttagtagagtttggaaagaaaatgtgtattggaattaaatttagtggcatgaaaatgaaaatttctctgtcattgtctttttttttggctccttttttggccattttacagctagtgtttagtgtgacaaggatcaaaattggccctttaaaaaaatatattgaattctattacctctgttatctaaaagaattgtatttttcaatttgaagagcttgaagccaatactactatataccattaacttgacaggaattgaaaatctaattgaggtcattatgattagccttgtatcttgctagtattttctcaatcttattttgaatgttttgtgtcaagtgttaaatcctcttataccacagaatccagaaaatttaaatgcaacagaagtaaaacgaatataaaaattctatggttgttgtggaggggcgttcttggctaacccatagggtgtttgaatgtaaaggcagcttacagaactgctgctagttgaattgtggagggtttcacttttaagagtacatttgagacaaaattgcaattttggaatcacttattcctgcttgttcagtgaaataggagaggggggaattcctgagggaagctgggagatttccaggtgatgatagagtagccatgtgagtatttggctgaaacagagtagaagccacctctgtctgttggacagaggtggccttaacactgagtatcaatcagcatggccattagagctgtccaggacaaacataatgaatgttgtggtggcagagagggtatacttaaatgaacaaaattggaggctgactttccttgtttcttggtagttcctttcttcgtatttgctatttggatatttcacttcacttttgtgagctagactcaaaggttaaatttatatcattgtgaattttctgggtcatattgtagggacacagatgggaagcatcccttcagtttattgagagtatttcttatgcgcatgtgtttttaattgtatttattgatttaataaatagccgatgagatgagaaaaaaatattagtgtcttgttgttgcagagaaaaagacattggatgcattcttagaatttattatcacatgcgaagttatttagatttacaaagcaatctgacatgttgacttcattgctcgtttgctcatttctatcagaggttgaacacaaagccaagcctaagcccgtgattcttctgtgtgcagatgagggggaaggtttaatgcagaatgtttagctgaatatttggattgtgcattccccttttatgtctctactgcaagttttctcagggcatttgtgattgacttctgtgatgttgacatttatttggagttagatgtttaaaaaattactaatttatggcctggtgcggtggcttacacctgtaatcccagcactttgggaggccaaggcgggtggatcacgaggtcaggagatccagtccatcctggctaacatggtgaaaccctgtctccactaaaaatacaacaaattaaccgggcgtggtgacaggcacctgtagtcccagctactcgggaggctgaggcaggagaatggtgtgaacctgggaggcagagcttgcagtgagccatcgtgccactgcactccagcctaggcaacagagcgagactccgtctcaaaaaaaaaaaaaatttactatcttattgtttctctcattttgaatttgtgaaattattattcattttatggacatactgcatggattctgtgtttcagttatgacaggagatctagaatctgggtggggctgtgagtaaatagaaaggtaactcagtctgtgccttgaggaattccgcagtccagtggaggaagaaagagacggagaaataattaggtacagtgtgccaaaggctataatagaggaggtacaaactcttcccagagaaggcaggcagaatttgaactaggtttcaaggatgtgtgaaggtgaactggggtggggagggcttcccagacagaaaaaacagcgagggtgtagagtttcaaagggggaagcccaggggtataataagtgaaggagacagtgtgaaattataaattttggatgcccttaatgagtttgaacttcattttcttagaaatggagtacttttaaatgttcctaaaatggggacgaggcattgatattcatggttcagttaggtttaggagcttttgtagaagtccttttcaaggtctgcttaatctcatgggccagatagtgacacctcgatgcaagggagcatgtaaatgtgctctattagctgggagcattgctatcagaaattacatttccggctctcttcttaagggtaaaggagaggtaggatattgagtggcaactggcattctgggatgtagaagaaatacagtaccataaagggatagaggaaaatgggtagacttaacgttctgaaccaaagctaagattctccgtgagcgattagagtaggcttttgggatttgcttaccttctcttatctgctagccagccacacaggaagcacatctttgtggagtgacagaggaggaggtaggaaatgctttctcatttttatggtagaaacatccaagagctgagccttcattctggctgagagaactctagatggttcagacttgcattcctgggaaggccttccagctagagtgatggaacaaagcaatgatttctgtggccctgtgtggacagcagtggcagtcagtttactctccctgttggttaactgtctttcgtttgatctagagacttcctcaaaacaattttgttgtgcttgttctttgaaagcaacagcagacaaaacaagctttgaggtttttagaaaagagcttgacactgagcacctcttttgagctagatctgtctgtcatgctgaacctgttttctgtggctgcgtagcttttcaaatctgtttatgcttgctggtgttattgaaacagaatgggaagatctatgcaaaaaggaacattgatcttaataaatttatgtcagtaagaatgggactgccattttaaaatttattttaattccttacctattttcttgttcaattattctaaaagtgattaaatgaagatacgtcacagaaagtatgctttgaaatcaagatgtggggaaaacctgtagttctgagtaggcctgatagaatcatcattgttagagtatttggaggttttgtagtagggattttgtcttcacttaaatatttagttgaaatatgttccaatagtttgacacattacagaatctgtctgaaagaaatgtctaaaatatgattcctcagaagctgctcttggttttactttctgctgttggttttactttctaacatttcattttgatcccgcagttttaagagtaatcaaaaaggccgggcacggtggctcacacctgtaatcccagcacttcgggagactgaggtgggtggatcacttgaggtcaggagttcaaggccagcctggccaacatggtgaaaccccgtctctacaaaaaatacaaaaatcagccgagcgtggtggtgcatgcctgtagtctcagttactcgggaggctgagacaggagaatcccttgaacccaggaggcggaggttgcagtgagccgagatcataccactgcattccagcctgggcaacagagccagactctgtctcaaaaaaaaagagtaatcaaaaagctacattatttaaatcttggcatgtctttaaaaaatgttaaactgtcaggaaaattatcacttctggataccaccttcagaaaaacacatgaaaatttgtgcatgtctcaaatagttgttaatttatgaaaaattagaaagagtgtttgaatgtatatttctgtcatattatattgctcatatttttaaattatactttttttcacccgtgaagcccatatagttaagtttgaaaattttaattatattagaatttgaaaattaaataaatctcctttaattcatgcataattttctaatagtcatatagtttgtattatataatttgagaaacttggttctaaaaaaattgtctgccaaagaatgtatatttctgaattctgttctgctttcatacatctgaaaatatttgagctatcataactggctatgcttcaaacccagtctgaaatgggtgacctttgctggctttggattgcagagctgggggctgttgtttgctttatctgatttaaaatagtcagtagtttattttgcaggcagttagatgtatacctttgcataaaatcattgaactgaaaaggttggcactccaagaatacgttgtgagaaaagagaacttgagtactcactctcgactcacctgaatcttattaatattttattgattaatatctgttgtatttttaagtaaataagctctctagaaactatctctgcttctttgttcatttaaaatatattaaacaaattgatacagattgcaaaaattagttgcaacgttcctagttagatatcaatgaaataaaaatggtctattcatacgagttcattttagttattcctactaatatcaaatgtgttttaaaaaatgggagattataatctttttatgaagtaagataaattattactttgtatatttaattcaaagaaaacaaaaaggccacaagtgcctgcataaaggcacatccacttaggattattgttaaggcctacagttgataattaggattcaggcatagcataaatgaagtggtatctttttttttttttttttttttgagacgaagtctcgctctgttgtccaggctggagtgcagtggcacggtctcggctcactgcaagctctgcctccctcctgggttcacgccattctcctccctcagcctcccgagtagctgggactacaggcttccgccaccactcccagctacgtttttttgtatttttggtagagacagggtttcaccatgttagccaggatggtcttgatctcctgacctcatgatccacccgtctcggcctcccaaagtgctgggattacaggcatgagccaccgcgcccagccagatatcaattatttttagacccaatgatatttgctgttgatttattgttggtgcacaaaataagaaaacaaaagcatggttttaaaacagccctttacacatttaatatggaaatggtaacctacaggtctgtattccatacagattcctgggctcattttatctgtgaattcctctgggcgtcatgcatgcccaggactgactttaaagcagaattatccagtagaggtataataggaccgttagatctaatttaaagttttcaagtagccacataaaaaaataagcaggcgaaattaattttagtctgtcactaaattcaaaatgttatttcaacagggggtcaatataaaagctatttatgaaatacattattttttcatattatgtcttcaaaatgttcacatttcacatatttattttttattttattattactatttttttgagacggagtctcactcagtcggttgcccaggctagagtgcaatctagcttgctcattgcaatcttggctcattgcaacctccacctcctgggttcaagcagttttcctgcctcagcctcctgagtagctgggattacaggcgtgtgccatcacacccagctaatttttttatttttggtagggatgagatttcaccatgttggccaggctggtcttgaactcctgacctcaagtgacttgccgctttggcctcccaaagtgccgggattacagttgtgagccaccgcacctgattacatatttcacatattttaattcagaccagctgcatgtcaagtacttagtagccacagatggctagtggttactgtattggacagtgcagctctaggagagtctcttcaacctgcagctgtctaggaagagaatcatagtttctggaacaggtagaatctataagacctcctttttaagcttctccactttacagatgaagaaagtaatatctggagatgttgagttgttcaaaatcacccacattttaaggatcaagagcccagtccctgttctctaacttctaatctctttcttcatcactttttctgcttcatgttgctgcatcccctttagttactaaggtactaacgttaggttgttgctatcagttaaatattaagccaggagctttaagacaatctggcccacttgaaggcatggcctgatttggacaaaacttgtggggtaggatgaatagagttaccaggcatatcttcaacctctctgtggactagtattatacatatatgagatgatgtagggtccagtgatcagttcatctttttctattgtgagcactgttggaataggaatggggggaccttttgggacccaggatatgtgattctgaaccctgaaatgtcagatgcccactaaaaggaaggggagagatggacctgtcattaccttacacattttattgtctgtatgggtatgtaaacatgtacagattataaggaattgcacttcatttctgggcttctggaaacacaggtattaagatttcatttacctccccttgttttggaaggcttattgtgtgtgtgcccatagttcttacccagttacacttaaagtatgatactttttgacagcttaagcctattgcattcctggcatgtaaaatagttattttcagaatgtaagcaaatgtggaaagcttactgcctgacatggagggttggagaagtgggattggtgttcttttgttgtaaactcatttttgtgaaatatttgctttacaacgtgaagcatgcatgatggatgaacttttagaattgaaagttatttttcatttcattcctgaaatatttaccagcatggatgttgactgagtgctttgaagagtttgcttagtcatataacttaggttttatgattttagatttaattaaacttaaagttttcctgtttgatcctcaggacttctcatctgtggcaaggctttactcacaaaggaaatatcaaccttgaagttaagcatgccctgtgtttctttatattctgatgaaaacgattgaagtttgccagtgctgtgtctgggacaatgcttagaggattcatggcttgtaggaatgagttaaaagtacaaggatattggctggcatggtgactgtcgcctgtagtcccaaaactttgagagtctgaggtcagaggattgcttgagctcaggagtttgagacaagcctgggcagcataaggagatcccatctctatgttttttaaaaaagtgaaaaacaacaacaacaacaaggtacaggggtatctgcgtttccttaggcagctgtcttatatacctttaaccttaaaaaaatccaccatttttaaaacagtgttttctgttgtttttcttagtaaatataaacaataggaactgaagtttagggcttaaaatttttgagagaataatttttatttcagtagcttttggggtacaagtggtttcttgttacttagttgaattacgtagtggtgaattctgagattttagtgcacttaagtagggtaccttgtacctaatgtctagtttttcttttaatccctagtcccctattaccctcctcctcgtgagtctctaaagtccaatatgtccctctgtgtgcctttgcttattcctaacttagttcccacttataagagagaacatacggtttttggttttccaattcctgaattactttacttagaataatggcctccagctctatccaagttgttgcaaaagacattattttgttccttgtaatggctgagtagtagtccctgatatatatatgccacatcttctttatcctctcattagtcagtggccacttaggttggttctgcatctttgcatttgtgaattgtggtcctgtaaacatatgtgtacaagtgtctttttcatacaatgacttcttttcctccgggtagatacccagtattaagattgctggatcaaatggtagatctacttttaactctttaggaaatctccataatgttttccatagaggtggtactagtttacattctgagagaataatttttgtaaaattatgtttaagctagatttggaattgggaaagaattacattctttataggaagcttttgaaaaatatatttaaaaatatataaaaatatgcataatcctaccacccacaaatgtctgtattattatgtcatttctaaaccatttttgagattatgctatagattacgttttagatcctacattttatttcttaacattaaatctcatactattttaagttctttgtacatgtaatgtttactgaatgggtaaatctgtttagggaaactggagctatgtagttgtggacttgtgcttttgttttgttttgttttgtttgtttgtacatttgctttttagaaatgtctattcagatccttggcccatttttttttttttttttttttttgagatggagtcttgctctgtcgcccagactggagtgcagtggcgcgatctcggctcactgcaagctccgcctcccgggttcacgccattctcccgcctcagcctcccgagtagctgggactacgggcgcccgccaccacgcccggctaattttgtttttgttttgtatttttagtagagatagggtttcaccatgttggccaggatggtcttgatctcctgacctcgtgatccccccgcctcggcctcccaaagtgctgggattacaggcgtgagccaccgtgcccagacagacatgtgcttttttatttggcatttctagcctgaacataggctggaagtagtgacttagagagggattgtttgccaaatatcaggtaatattttaattatttattatttattgtaatgctgtgaatcaggagtccctaacccctgggccatggactggtaccggtctgtggcgtgttaggagctttgctgcacagcagtaggtgagcaatgggtgagtgagtgttgctgcctgagccctgcctcttgtcacatcagcagggcattagatgctcataggagcgcaaaccctattgtgaaccgcatgtaagaaagtgagagctgcgttgcacactccttattagaatctaatgcctgatgatctgaggtggagcagtttcatcccgaaaccaaaccacaaaattgtctttcatcaaaccattccctggtgccagaaaggctggggaccactgctataaattgctgctgtcaagtagtgttacgcatggtggtctttaacataaaaaaaaaaggtaatgaacgtacaccacacagattagcaaaaataaggaaaggctgatctagtagttcaaacaagcaatcctcttatttaatggttctgtgattgctcgtgtaggcagaagcttaactgtaagttgttgcatttgacaggcaaatgtagctggagctggaatgtagatattagtgaaattgtgatttcagtttactggagccattcagtgggagcatgaagtgggttacatgattacacggatataaataaagcgtcctccttgccacttcactgctgttaaagtctctcctgatgttatgtggtgaaaaacaagtcaaaaacattaattctgtcaagtttccaaagatataagaatctttgaccagaaaagagacggtatttatcttcaaatttaacaaattgtgatgaaatgctgctgttacagaacctagtgtaaggtcgtggagtccattcagccagacacatgtaattttgattattaactgccgtttctgtggtcagtcggccagttttatatatttcacattataggtatttggagcaaagacagtgttgtttattgtttactttaaaaaaatacaatactgtaactacataatgagtaaatgttgatactgttgaaaactaataaaaacaaattcttacactatcaacatcacagaaattctaattgtaagaaaatattgatataatatggaaatccgttcatttatttggtgcattaattgaacaccaacactatgccaagcattgggatacaaccatgaaagaggccagcttcctgatctcacagagcttgtactttgttgggtggggcagagagcaaatcagtcaatctgtctgtctgtctgtctatctatctgtctatctatctgtctatctagatgtcaatcagtatactctgtgccacttggtggtcagtgctatgaagaaaaattaagccagtgaggagctggatagagacacagtctggaagggtatgaaggggatcagaatatgctacccccaaatatgccatttcagcaaagtactaatttgagctgaagacaatcgagaaatagcagacccaggacaagctttaccccctttttataaaaattttgctgtgtgaaggtatcctccttcccctctccatccctggagagaccactagaggtggcaccatcgcctgcagaaacaaaccttattgaaataacccttatcttctattagtttcccccatatatttaccttaccacacttcccctggaagccctaatcccctctcctttgtcttgtgacttctccacagtttattgctctttgttaaaatggtgtgtatgctctcaggcctaactgcttcttttgggtttttgcttttctgtggagctccctcctctcccctccctcatgtaaaaataataacattaaataaaatttgtgttttttcccctgcgaatctgtctcgtcagtttaattggcaaggcctcatgtgctgaacctaacagggtagagaaaaaaggtttttttccccttttctacaagtattaaacctggagagaacaatacagtgtaaaggctgtgaggtgggagcatgctggggtgttggaagaagcacatgagcttacaaacattccatcaatttgcattcattccaaaaattgtatgcaatttttcagtgacgattcccattgatcaatcatttataaaaactaatggtgagggtcttccatactcagtttactcccttcttggaaaagaatgtacattttaatcaagatgatttcatgaaagacattctgtactccaaacatttaaaagagcgtttagagtatacagcaattcatcttttcttctgtattttaaaatttaagacagggagaattattgtattatacttagttcagatttggtggtggttttgttttttggttccagtgaaaagaaattgcatcagtaacctggcggtcaaccgtgccatattgtttgtgatttattagtctggaaaaaataactgtatttctggcatatgtaaaaatagtttgctgagaggcctccttggttgtggcaatagtaatactaattaccaggtactgtatgtagctcattctatgaaccaggccttgttgaaaagtgctttcacttaattttttcttttcagcagcctgtgaggtacctactgttatccccagctgggagggagctggccagtggactgggtttaaactatgttttcattgtctttactcttaaccacttatcttctctgcctccagcaaaataagtcaaagagttcagccagtgtttcttcttggactaagcagtcagcctcctaagtaagcaagccttggaatgcaattgattggtaagatactaaagtaatcagtaaggccctcagttcctggctgccagcttctttcaccctctcctgcaggaagttctgaatgctgatatctctacttggtgtcttctctccccctcccaattccattatttccctttttctcaatcccaagtgaaggaagttctgagtgtggatgttggagtcattcagaccttggatctgagtcacaactctttcaatttactagaaatatgactgcaagaaaatgatgtaagcttccctaaaccaatttccacatctacaaagtatctaaatagattgcttaggagaaaaattgaattaaattgaataaagtgcaaagcacagaacatggccaggagtaggccctggatgaatgagggaaaaatggttctgatttttatttttgagcctctttgtaacatttgttggccccttcagaataatccttagagttcatatcagccacccttcatccctcctgggatgggccaggggagaggcccagttgcctgtgacactgcttcgtttcacatttcactgctttagcatctcaacatttcattgataacatttttgatgcctgaaaacagaataacttatttgtaattctacatacattttgtttgtgatcaagttgttagagtttgaaatgagcctcatttccttgggttttgtccctccccatctgaccttcctcttctcagtgaaccctgaagaaaaaacactagcaaaggaatctcaagaatgttggttcgggacacagctctctccatctactctcctgccctagtcctgcccctccttgtgttttcagcggtgaccaggcactggtgacagccttggctgcttggaccagctggaggtagctgcaaaatgcctgcctgctagctttgaaaaatctctgccaacctcattgaaataattgtttaccacatatcagaggggactgggaagtgggtaattgagagatctttttgaaggggtttgtggcttctccacttgcagaggcttcctgaaatggtgggtaatgctcatgcctcagggagaatcaatatccttctcctaaaacctgctcacacgtagctctaagtattagacatgcatttttgttaacattttatcagtgcatttttctacctgtgtcatttggaccttagattcgggagaaaatcactgtgtatctttggtggtttcaggtggctcttaaatttcattaattcacaaaatctgaattgaatggaatagtctgttttgggaggtttttttgggggggttggggagggattggatttttcagtccttccaagagacttcaggttttttttttgatgttctgattagcccggtgtgtgtaaggccctatcaggtgttcgcctgtgtgatcctatcacacccacatcctgtagctgcatccaagtgctttgaggccgacttaatggggattaacttaacagttgctctgtgggaacagatgctctttgccgcttatttctaataaattgattgagccatttaaaagattttttttttcttttaagttacatcttcttaagaaactgtagacaataaagcaaaactaaaatacttgggtctaaaattagtgtattatatttaaaacactgggcttcagactgattatatcatgctcttttactgactttctagtcagatgcttatttataaaaataaagcttatataaagggcagcattcaaatgttacaccagtcggttttagcagtttgaccttccacagtagctaaatattttttacactgagagaagaattctttaacattatatgctatcagcatgtcaagtgaattctgagcttgcatgcaacagatgagaccctaggtggaaacataaaaacataccagtgtgaaagagaaaagcaggctctctgtctttgggaaggagttctgcagggaggggtgtttataagtgtagtagatacttaggaaaattaatacaattattataaaagtcatctgggaaaaaccattaggtaagaatagccaataaaaaaccagaagcaaaatgtaaagatatagaaattaaaactgcacatcccatgcatagataggtcaatggggcaaactggaagtctagaaataaagttgtgcatatattggaaattagtgcaagataaaagtgtctttttacatcagaaaggggaaagatggattatttagttaatggtgttgggttatctgactgtacatagaaggaaggtgggtaattatttacccagtaccaatactggattacctagtattatgtacccagtacagtttgtcagcaacaaaaggcaaacttttttattccatgaagtgttcttacaaatcagtaagaaatactaaatatgaacatcttcagagaaaaatgaacatttttgaaaacttattatgaaaagaattaaacatacacaagagagaatagtgcgctgaatgctcagcaatgatcagctctcacccagtcttgttttatctgtattcccctttctcaacctgctcaattctcttttccctcactgggttattttgaaataatttcaattctataattttatgtataaatatttcagtgtggatgtctaacagaatctctattagacgtggacaaaaaaggcaaagaattttatagtacacaggaaaaaatacacagccaataaacctatgaagatatgctcaatctcatagtcgtcagggaaatgcaaagtaaaacagtgatataacattgttttttaaaaccctgatgggcaaagactaaaaaggcttgccagattggcattttcatctactgtcaattgataacagatatttctttgcttggagtacagtggcacagtctggactcactgcaacctctgcctcccaggttcaagtgattctcctgcctcagcctcccgagtacctgggattacaggtgtgagccaccacgcctggctcattttttgtatttttagtagaagcagggtttcaccatgttggccaggctggtctcgaattcctgacctcaagtgatctgcccactgcaggcatgagccgctgcatgcagctggtacagaaattttttagatcagtcatttagaattttatgtacatatcccttgatctaggaattctagaaactaattagttcatagtatattgtataaatgcgcacagatgaggatattatgagagcattatttgtatcaactaagcaagcctttaaaaaactcttatacagtagaatattatgctgatacattaaaagtgggcataaccatactgatgtatagaaatatctaaaatcataccgatataagtgaaaacattcagaatgcaggcataatcacagattaaacagtaatttatataaaaaacagaaaatttatatgtgtattatgtcagtagcagattcaagtgaatctgacaaaatctgactctgggcaatgagaacattggaatggaggagaaggtagtacatatttactttgtatattatcaccttttgtactatttgagtctttttaactgtacgcagatactttagagcaggggtccccaacacccagccatggacaggtactggtccatggcctgctaggaaccgggccacacagcaggaggtgagtggcaggcaggtgagccagtgagcattactgcctgagtgctgcttcctggcagtagattctcacaggagcacaaaacctattgtgaactaaacatgggagggatccaggttgcctggtccagtccttgtgagaatctaactaatgtctgatgatctgaggtggaagagtttcatcccaaaaccatcccatcccatccagtctcatgccatcccacccccaacaccccatggataaatggtcttccacaaaaccagtccctggtgccaaaaaggttagagatcactgccttagaggctgctccctcttggcacatcttgaatgtaggactccttggttctgccattcctggtaggtagtcagccagcttttgatagttctccccagagacttcatcccacaggcaagccatcccattccacgtaaaacatctctaatgttaggaaggcacgtattttgatgtgatatctagaatcctcccagctgttcttcagaggaacattacttttataaagttgaaaagaacgttttattgtattataaaactaggtcatttcagtgaatttcatctattttcatgggtaactgattcttatatcaaaacttgcttttgaaagtactggaagcataaattattacttcaggcccatttgctttactttgttcagcacattgaacatcaaggagcaactccctcgatctaaaatttctagcattggtgcttgtaatatcatttttcaagttgacattaatgctatctttggaattctcatggtaagtcagaagaaagcagtttagtggaactgttctttctcccactgaattgtatactgagatctgttatattttctgcattttaacccagaaagttgttcaagagaattgaccatgataagacatctgtagcttattttgtatttttttaatggaaaattgtaactgacttttaaatttaagattgagtgtagcctttcccaaaccaatagctaatgtttttataactatttagtgtaggagattataataaaatccacattgcttaagatataaaatgtttgtgcagtaataggctgtataaaaacagtaaattgagattgtatcaggaataatgtattataaaccatatatgaaaccaggtactaacttggtattctgcatagctttatcagaaaggcagagcaaatactatctcaaaatgaagtataaacaaaatgaggttcagtgagtgatgtggtttggctccatccccacctggatctcatcttgaattgtagtccccataatccccatgtgtagtgggagggaccaggtggagataactgaatcatagaggcggtttcccccatcctgttctggtaatagtgagttagttctcacgagaactgatcactttataagggacttttccccccttttgcttggcacttcttcttcctgccaccatgtgaagaaggacgtgtttgcctccccgtctaccctaattgtaaggttcctgaggcctccccagccatgctgaactgtgagtcagttcaacctgtttcttttataaattactgagtcttggatatgtcttcattagcagcgtgagatcagattaatacagggaggctacataatttgacccaagtagcaataaacaataggggtgaggttgaaatccaggcccctggtacttatggccttaagctaagtgaaataagccagacacagaaaaacaaatactgcatgatttcatttatatgtggaacctaaaacactcaaactcatggaaacaagagtagaagggtggtgttaccagggtttggatgtgggggaagtgaggcgatgttggtcaaagggtgcaaacttgcagttatgagattaatacctaatgtacagcctagtgactagttaataatagtgaattgtacacttgaaaacgtctgcgagagtaaatgttaaatattcttaccacacagaacaaaaaaagtaactctgaggtgatggatatgttaattagcttgattgtgataatcatttcacagtgtatacatatatcaaaacatcacgttgtatacattgaatatacataatttttgtcaattatacttcagtaaagctagggaagaataaaagaagtgacctaaccaggacacctatctgtagctctatggtaaagccaaaagggataataacttttgattatcaaaacttcatcatcattattattttttaagactgggtcttgctatgttacttaggctggtctcaaactcctaggctaagtgatcctcctgccttggcctcccgacatattaggattataggcatgagccatcacacccagccagttttgaaggtatctttattacatttttttgtttaaatatttaatagtaagtgtttaacttgaagcatttttttctgccttaaaattgattttcccactcattttatggatcaaaactattatcagattttaattcccactccaccacattgtttataaaagttgacaattatggaaagtaaagtaatactgaatttttctaatgcctatctttgacatggaataaagattataaaatttcttataacttgaatgagtttttaaaaattggacatctttttataaaaatctagcattgaccatttcaacataagttttacttatctctgaaatacaggtagtacctatttttattaattttcttaagtgatgctgagtgacactatttttgttttttttcactttttctttactttttttttgagacaggatctcagtctgctgccaaggctagagtgcagtggtgtggtcttagctcactgcagcctcggcttcctgggctcaagcgatgctgccacctcagcctcctgagtagctgggactacaggtttgcaccaccaggcccagcagttttaaagattttttgtagagatggggtcttgctgtgttgcccagactggtcttgaactcctggcctcaggcgagcctccgacctctatctcccaaagtgctggaattatagacatcaaccaccgtgcctggccccagtgacactgtcttaattttgaatagggaagtatctaatggtattaaaatggtctggcagagaaggggatatgaggcttggtgaaaataagcacaggatgcaccatctttgagtaagtgttagtttctgcagtgagccagcagcaacattcttagcagagcctagaaagatcgagtgagggctgtgtggtggtgcagcctcttaagtctctctggttccacaacatgctcagattggtggctttgatattttctccatccaggacgcattgtgctaagcttagggaaggtccagtggatatttaccaagcctcttatactgccccgcatgttgccatgagacagcagcgttatcaccttaaatggtgcaaatactccttgtgcataccctacccctgagatctaacatctggattctggatactgtttcctattcttccatcttgctgcatggttcccaggttatgtatatagtgtggctaggcaccacacatggccctggctccttgcagccatacagaggtgacctaactggatgtaattgggtatgtaccgggtgttggctacctgtgcaggttgagggccttccacaggtctagcaaagcaattcattgcctttctgaatttttgaatgcttcatttgtgaaacccttgatgtaataactgttgatattatttctttttgaaaactccccttactcttccctgtttcttcatttgtaaactggaaccgatagaaaagtaccaaacttagggttgttgtgaggcgtaaaagaaataatacagcccagagaacatagtatatactcagcaagtatttattaatatgactactaagccagcattggtgattgattggctcatagtgtcttctatttgccagatgttttcagaggctctgttcatgttcatacccatgtttgtaaatgacagaatgtaaatttcttaatcctctgtcttctcctttagcatcagctcttgtccccaaagtaaaagaactcagtcatccagaacccagttttgtagatctatttttcaaaattgggcagttaatagaaaattaaaagcagtctagggaaaagcctttcctttgggtttgttgctttcttttctgtcataataagactgtgcccaaactgtagggaaaaatcaagaaactgtaaaatacatcatcagggtgtttatagtaaatgtaaaacgttaagtaacatttgagttaatctgtgcttgtacaaacctcagaagcttaaataatgaaccaatgacatataatttagaaagttttcattagactctttgcgttggtatttgcaatatcagatttgcatgtcatcattattagccttcctctattttgagtgttgactaggtgccaggcgtcatgttgagaaatttatgtgcttatttaattctcacactgactccatgagatagatactccattttacagatgaggaccccacatcataaccttttggccagaattacagttagtgttagaatttaaacctatgcagtctcattccaaatcctctgtctttactcctccagaatgctccattaaatgaattgtttcttataatccggttgttttaacgttggaaaagaacttgagaacatttagcccaaccaccctatgaagtttggcagtacttcttgccattctttcaatagataatttatttgagtttaagggagagtctatgaattaacactagtaccaaaactcccatgagaaaataatgtagacagcttttgttaaaaaagcagaatttttaaaggtgttcattcagttatcttcttgcctaacaagttcctgtgttgtgatagactttgaatttgttaaatatgaattggcttcctgattctagctgttttgccagaggcctgatttagagaagggattaaaccactggtcaaccttggatggaatttgggccagcagttccttctccacagcccctgacacttggctttgtgccaagaaaatcctacaaaaggaaattgatttactctacccaagacagagttccggaggctttggttgtccattgttagcttagaagttggcgcagtgtgcgtgtgatccacgcctaaatagcacagccttgctgtgcgtggtagaagttgggttagtgttgacatgctgttgactcaccctcccgaggatggaagctctggcctgggtcaagttgtggtcactgcagttaacagtttgttgatctcagggagtattccacagttgctgatgtaattgacaatgattggagccagctcttccccagattcaaatggaccaattagaggacttgttggttctgtttatcaactatgtaagtgagtactgtgaagttggcattgtttttagtctgtatttgggtaagatgaaactctgttctcagacagtaatatctttcaaaagtacaatgttacttattgtgaccaaagtagggatgaagtttgcaaattatttggtgtaatgatttaatttggccatccatgcagtgcagttctctaccagtgtgattgttctctttgtaaaatactcttactttgccagaaaattgtttgtttgtttgtttgtttgtttgtttgtttgtttgttttgagacggagtctcgctctgttgccaggctggagtgcagtggcccgatattggctcactgcatccttcaagcaattctcctccctcagcctcctgagtagctgggactacaggtgtgtgccaccacgtccagctaatttctgtatttttaatagagacgaggtttcatcatgttggccaggatggtcttgatctcttgacctcgtgatctgcctgcctcggcctcctaaagtgctgggatacaggcgtgagccactgagccctgttgaaaattcttattaataagatgtttctcatagaatgtttcaaaaaattgtgactggtttcaaaatcagatgatttgcaagaattagccatagtataaacacatagttctcaaaccgttttctgggagtgggcccagagatctatttaacaaaaccttgagtagagtctggtgcaagttaaaattggagaaccactaatgtaaccttaccttatctgtggaccacattttgagctttggaagaaataaccctttctatccttcacaaggtaacagatgatttttttgcacaattatttgataatgagcttatatttgagattaaggtatgcacacgataatgtacattctcactctaggtctggggaccttgattctttgactcttctgtccttttctctccagttacttggttttgtgcattaacaaacttttcaatttacttatttttttttacttatttacttatttctcatcccttacgtaatgttgcatcattgttttttgtagcctctgcagttcaagatactaatcacccctttctaccacattaaaatacagactctacctaaaatcatgtatgggagtaacttgatatatacgaaagtgtaaccgtgtcacaattccccgccccaccccgccagtctacataaaactgcaaacactttattgcttaccaagaaagtagacaataatatcgaagaaagccctccttttcctcttctttgaccaacaagggagcagttcctgacaaatgtcagtttgctttttgagttccttaggtttctgtgttgtgtttgcaatggataaatattgagtaacaggtactgactgtattgtatacattgaaaactatccaccaacagaatatttgcaggaggattttgttttgttttgttttgttttgttttgttttgttttctgagacaggctatctctctgtcacccaggatggagtgccatggagtcatcatggcttactgtagccttaacctccttgtctcaagcgatcctcccgcctcagcctcctaagtagctaggactacaggagaggaacaccatgcctggctaatttttttttttttttttgtagagacagagtttcgctgtgttggccaggctagtgttgaactcctgggctcaagaaatctcccaaagtgctgggattataggcatcagccactgtgcctggcttgagaatgacattctataagtagtttcagtcccttagtttaatcccatattttgatcctataacatgtacaatatttgtgtatagtatatgatctgccaactctctaagaagattttaaaacttattatgttaaatttcagacatatacatcatccagcttcaaaaattgaccacattttgctgttcttgtttcagcacctccccctgccccattttcttttctgaagcattttaaaataattctcaggtatcatatcattttacttctgttcataggtttctgaaaggatttgatgcagaatgttattattaaaccagtatacagagagaaaggccactggatattagtacatgttttggtttcagacggtccttttaagagtatattaaatcacataaggattttctgagtacccattagaaccacaaaaaatacctatgatacccttcttactgcagtagaagatgagtttcctagggtagccctttgttgatggaacaaacatgtattttgtttcatcaggaaaatcattggaacagccatgactcagatccactaaatgaaggaacaaaaataggacctgcctcacctcctgatttttttttaaatctctaggatgagtaaccagaatatttttatgttgtgctaagtaggtttgtttgtttgttttttactctgacttatattatttgaattgtagaaatatattgtttttacttttttctttaaaattctatctggagtttctaaatgagagattgtagctcctaaaacctttcttagttttggtgtcttgctttctgttcttagcgtctgtggtcatttctaactcccagtgaggaaagagctctctggtcttgtttctttgttaaatgaaggagcaaacctccgtctcgttgatccactcccaacccacttgttttgtaacaatgaaagttatctcatacttaaaagacaacttgaaattataacacacctgtaacaaagtaaagggtatgggtttttacttaggtttaaaaaaagggcagtaacccttttcataaaaaagcaaaatttagatgggatagaacccccgtttatagaaaagattttaaaatctcatttgctctcattgaaaccttaaccttctctcaaatactggcgcacctctgaggaacttcaaatacggtttgaaaactaatggtttaaggagggccaggcgcagtggctcatgcctgtaaccccagcactttgggaggccgaggtgggcggatcacttgatgttagcctgggcaacatggccaaatgctgtctctactgaaaataggaaaaattagctgggtgtggtggcgcatgcctgtagtcccagctactcaggaggcggaggtggaggcgggaggatctcttgaacccaggaggcataggtgcagtgagcagagatggatctcttgaacccaggaggcataggtgcagtgagcagagatcgcgccactgcactccagcctgggtgacattgagactgtctcaaaaaggaagacgaatggtctaaggaaactagtttgtggtttctcagcggagaatgacattctagtttctacagatctggcaacagaagacaggcacataaactggcctgctttggagtcagggccaagacttaaatccagatttaaaaccagctttttttttttcttcttctaaaacaaccaacctgtgttttaggtccagtgtctgccttgtaagttgctcaaagctcagatacaaggaagtaatcagcacacatttttgtgataacattcctgaaaagaaaaagatgaggtggactaaggtaaatacactgctccttaaaaatccatatttttagattatttataaatcaaatgggcatggttaccaaagatgaattctagaggtgtaaaactccagtcttatacctcaaatttcagttttccttagggagcaaaacacttccatgatcttactgaggacctaaaaaagcctgtacatattttaaaaatagcactccctagataaagcctgatggatccagggtacagtagaatcatgaaattgcctgtttctttttaaaagatgtatatgattgctcggtggctgtatattgtccatcgtgtgcgtgcctgtgtggtatgttggttctttcagagaggcagtggcgtgcagagtgagaggatcacagatgtgtatgtgacaaaactatttcttttctttcttttcttttctttctttctttctttctttctttctttcttttctttcttttcttttcttttcttttcttttttcttttttgagacagagtctcactctgttgcccaggctggagtgcaatggtgtgatcttggcttactgcaacctctgcctcctgggttcaagcgattctcctgcctcagcctcctgagtagctggattacaggtgtgcaccacgatgcctggctaatttttgtatttttagtagaggcagggtttcactgtgttgttcaggctggtctcgaacttctgacctcgtgatccgcctgcctcggccacccagcgtgctgggattacaggtgtgagccaccgtgcctggctgacaaaactatttctaaaacacaagtccagatattcctaccaagggctctctggggcttcgttttgatttatatgcaaaacactcctaatgtggtgacattggggagataaagatctgggatgatgagagagaaaggcaggtaggacacatgcccttccagtaactttccagctagggcttgcatttaacctctgatggaggcctcaccatccaggcagatgtacttgcttaggaatgagtttgagataataaggctaaatgtgctgccttctgtatataatttgcatttgtcctaatgtacgactaaggaaatgaaaaatcaaagtttgagtgactaaaataaaagaggtctgtggagtaattggattgaatttgcaccaagtcaaggagaaaacttctgtattttgtatgttttgtcatggttctatgattacttgttagaaagtgatataaaattcaataacttagtttgatatgaacttggctatctttaagttatagaagtcgtgcatataatgtggctgttttcaacccccataccctttctgagtggttggagatgtcttgaatttcgaagtgagaaggtctggtgctgttacatagataatcatgttagccagctttaccttctgataagctctcaatttaagaaagtacttctaatcctggctttatctttggcttgctatcttattatgcacagagcataattgtaagaagggaataatatctcttgctgtctattcactaagaatagtgtgaggacagggctcttaaaaacatgaagagatgggcactattgtatagatatagagatttgatgaaatgttaaaatgttggatgattttaaatgacaagtggagtggtgagaagtttatttttaaccttatgtggataccttggatatttagaaacatcgaagttttaaggaagaacaaatatcttgactccaagaaaatggtcatgtgatactgtggcatctatttggtcttcctgatgtatatgtttcctgacatttagctcctaaaatccttggaatctccagtgctaagaaggtcttatatgctaatgagatgactggtggctgggtaacctaccatgtgattagagggttaggactttcagtcaccctccccaacctccaggagctgaagtttgagttgataaactaatgatcaatgatacctacataatgaagctttcttaacaaccctgaaggaccgcgttctgggaacttccagatagctgaacacatggaggttcctggagggttggatgtcaggaaagggcatggaatctcgttttctcttcagccgcacctcaccccgtgcatctcttccatctggctgttcatctgtgtgtcctttgtaatatcctttaaaataaatgggtgaatgtaagcaagtatttctcttagttctctgaaggtgctccagcaatgaatcaaaacgaagtaaggggtctggggaatggtagccagttggtcagaagcacaggctacaacctggggcttgtgattgacatctgaagttgggggagttttgtggtactgagccctcagcctgtgggatgtgtaatctccaagtacagtgtcagaatccagttgaattagaggacactcagctggcatccattattggcatgcagtattccttgtcatgagcctgggcaacatagggagacctcatctctacaaatatagctgggagtggtggtgtgcacctgtggttccagctactcaggaggctgagtgggaagatcgcttgagtccaggaggcaaacattgcttctcctccaaatgctgtactttaacatgtttggaaactcctgcaaaggaatttcaacataagcgaagtcaatgggttataaaggactgaatgccattttgtaaatgtcagaaatcaaagtcacaaccaagttaagttctagattagggccaggaagagaaatgtattatctggtcaaccatatcaaatctgtattttggtggaagagcattttcttatattggttctgattggtttgatacggacagggaactgttttctttattccagttatttgttttgttttgtttctgagacagagtctcgctctgtcgcccaggctggagtgcagtggtgcgatctcggctcactgcaacctctgcccctcaggttcaagcgattctcctgcctcagcctcccgagtagctgggattacaagcgtgctgtagtttttgtatttttagtagagatgaggtttcaccatcttggccaggctggtcttcaactcctgacctcatgatcccacccgcctcggcctcccaaagtgctgggattacaggcatgagccaccgcgcccggcctattctagttgttaatcagttaacatagccaaaagatatagaataagattgtagactgaatccatagtctaatgatttgtcttcctagtaattgtgaataattcagacattcaaaattagtctggcatcatacaaacattagactagtcctaaaatgaggatattggcaagtgtgttaataaaaattgcatatgcagtattaataggttccttacgtaggctgccgattactcaggaactgtcagatgttttgttttgttttgtctttgagagatggggcagggttttactctgctggagtgcagtggcacaatcttggctgactgcagccttgacctgctgggctcaagcgatcctccctccacagcctcctaagtagctgggactacaggcatgcaccaccatgcccagctaatttttgtatctttttttagagacggggttttgccatgttgcccaggctggtctccaactcctgagctcagggatctacccacccatgcctccctaagtgctgtgattacaggcatgagccactgtgcccagcccccagatttttaatcttctctttgacattgagtttcagaaatgaagtataaatggtgaatttttagtgtagaatatgatgcactaggaagatcacttacccgtttattcactttcttagaccatgtcaacccgattctgaatttagggttctgttgtgatggtgttctttagaagtgattttaacactcaaaatactatagtctgtaacataatttactgattttttaatttttgcaaactaagttgaagtaatcaagtatttatgagttctttgggtgagaccatctgtcaaagaattctgggcttaatggagatacatatatgttgtgaatactaaacagatatccaagtaataaagcagaaatcatatgctgtgtaacagaaatgtaaagttctgaattagttcacgagtaggagagaaacttttttttaaaggtagaggagaactaaaagtaatttcttaaaagagtgcctattttacatcttgaatattaaaagtctaattcagtgccttgggatcttgttctttttgtagattttgatttgaatgaacttcagtttgctgaaatgtctaatgggtgcaaagtacagatttaattataaggttgagctaaaatcagaatttaagcatatggcatatataataccaatttaatctttcccccttaaatttagttatttttagtgagtcccaaacaccatatttgagacatcacttttttcttttttaaagagatagggtctccctatgtgaggctggagtgcagtagctattcacaggctcgatcatagcaaactacagccttgaactcctggccccagtgagtgtaatgtctcaccatgccaaagtacttttatcttaaattgcttatttttttgtttatttttttaactgactctgtttacaaaattaaccttttatctagtgacagctagattgtatcacatttgtcatctatggacaactgatttttagttgtttaatatggtaagtttattattgtttttccttatttaagaaaacaggatctgagtgaaaaaaaaaaaaatcttaattcaactatcacgattccagtaggaagtagacagacattcatctgtatacattaggtgtcaaagtagagttttgtggtttatcattctgaagatttgagattcaagacatgactatctttcagtcatattgtgcaatagataacatataatgtttctcactgatgagaacagttggttagatctctcagatgacttgaattaggtattagttcaagtcagttgtcagtaagtttggctttatcgttcagaggagcttcttatgactggacatttctcaagtattgccgtattggtcatttggctatcaatgcttaaattatactcagtatagtataaattttcttatttcccttatttaagcatgcctccattacactgttgttgtctctaataagagtttaataatctttgttttggcttagtaaaaagagccaacaaatatatgagtgactgactgagtgtattgctctatgcgcaattgtcttaaaggaaaaacgtttatagaatcactgtgaacaataaaatggttgcatttcgctggaaaacctcggtgctcctttggtaaataatgaagtgttttgttttacgggccttttcactacttcattgacaacagacctttttttttaaattaattaattaatttatttatttatttatttattttttgaggtggcgtttcgctcttgttacctgggccggagtgcagtggtgcgatcttggctcaccgcaacctccgcctcctgggttcaagcgattctcctgcctcagcctcctgagtagctgggattacgggtgagtgccaccacgcccagctaattttatatttttagtagagaaggggtttctccatgttggtcaggctggtctcgaactcccgacctcacgtgatccacctgcctcggcctcccaaagtgctgggattacaggcgggagccactgcatctgaccaacaacatatatttatattacccagtaataggcatagtctaaggaagataatagaatttattcttagtagtgaactctttggcttttgaagcagaatttttttttctttgttcttttctgtgatagtaaggaaggaaggaagggaaggctactactaaaaatataaattgctaaatagaagtcaagtctctgggtgttgaagctcacatattggtgctgtccagacctgacgcatctagaaacaggaatttgcccttagcgtaagcttagccaaatggttgagtcatttctaagtattttaacattatagaatgccttaggaaatgtcatgaatatctaaaacaggtcttcttgaggattttattagtttcttaaaacatggaaaggaacttgattctcagtgctggtacctaaaattcaaagacattagttgtgagttgctgtgctcctcagctctaagccacagttgtcatggccaagcctgtctccttatggagagtggccttgctgtttcctgcagagcttctcttgtgcctggcttgtgcctggaagtcagcgtgtcaccacttcagagagacactatagaagcttggtgatcttcaaacaagaacttaaaacaaagaagttttctttcacagatatcttaaaacttgtagctaaataaaacgtgaataactgtgagagcctcattacagcaatttttaaaaaagcagtacatgttttgttgtatcttaaacatcacagaatggtattgtgtgtccagttttgtttgtaaaatgtaaccttcgtgtgaatgaccatctattcctttctttttggaaggttagtttgtcagctgttgtgtgatgctcaacattttatgtaatgacatttagcacaacgtttcaatataacatctcaggaaaacatttaagaaatagtgaagttctctgggtattacattaatcatattaattacctgttgcttttaatttatcaccgtatcaccctaatatcacaaggcatgtgtagtactattttgtaaagattttctaaagaccttccctctataggaaggaaaatttaattcagaaattgggctgaactctctttcacttgtgtgaaaatgggaaaattagaagtaatttgtattttttattgtgaaatcagtgtaggaacctgtgctcgtatcatggaaacaacagcactaatgtttttctcccctcgggtgtgggctttgctgcagatatccatgtcttctactttttctgttcttagttcttattcacttattgtctatacttcgtgtcactttattgaatttcacaaatgcaatttaggaatccagggatgtgataaaatttgtgcatctgcttgtcattagccatctcacgtttatatcgctaagtgaaaatttaacttagtttggaacaaaccaccatgatttagttcacctgtatagtttaaaagacctaagacctgaaatttttttttttttttgaaacggagtctcactctgtcacccaggctggaatacatggtgtgatctcagctcactgcaacctctgcctcccgggttcaagcaattctctgcttcagcctcctgagtagctgggattacaggcagctgccaccacgcatggctaatttttgtatttttagtagagacggggtttcaccatcttggccaggctggtcttgaactcctaacctcatgatccacctgcctcggcttcccaaagtgctgggattacaggcgtgagccatggtgcctgtccaagacctggaattttacactgcattgggaccttataaaattcttgacttgtacccttttggcattttctgaatgctcatgatttgcttctgaaatattttaggcctttggaaacactccttcattctaatcctctcttttcttgctctcaattcttcatgtcatgtaattattttgcctagagccaaatctgatgtgttattataatcatcatttctgcaggagcttggtaacactcctgcttttgttccctttaaggcttcttttggttttgtttattttgtttcactcagaatgatctggttaagttttgcttgatcatccatttcaaatctcttagtacatttttcaaattcagttccaagcatgttaaatgtgtcacaatggaagtggcccacggtcaaatacattttgggaaaccttggttttaaaaaagttaaactgacttcattattacggttttttttttcaaaagcctccagtatccatcttgaatgatccatttcccatatgtgttttatgacagaattctccccactcccaggtaataactgttgacattttctgaaaactgtttttgagaacactgaattagatatgaaatgaggcatttattcatacttcgaaacgaatgtcttaaacctcactgggccattttgagtatacattactagtgatatatttaataacttagtggtataagcatgcaataacaaatttcttacacaagagaagttctgtgtagaaacaaatttaatactgtggctaaagaaatgaaccaaaaaaatttaatatcttgaaatttgcttcttagctctgtttagaatcattgtgattcacggatagtaaattgtcagagtggacttcatgaaccttatatcagacattctgaaaagagctaaaattgccattaaactgcatgagttaaaatatcttagatagtttaaaaatactatgtagacttggtgagtcagatctgccacactgagcgtgtagctggggttgacgacacacgtgttgcagtgtcgttaccagtttgtctcttttagagacaacttggcaggcagacgtcttgcagataaacaaggaaagattgtctattttaaatggcataagacattctttaaaccagtgtgtcatatgtggttatatagtcagcattttctttagtgcaggaaatcctctctcagggttcctgaataaatagcaggtatctttgtagggatagctcgcaggagatttcaaatgctgtgtattcatcagttcaggctccccagatgtcttacgaacgtgctcattttagttttcttttcttttccctcttcctgctagatacaagttgagacaatatgattagctcttaaagtgcttactctccattttatgtatattactgcattttaatcctcataatatcctgtgaggtgggatgttactatgtccatttgagagataaaggaaatcaagaggtaaagttaactggctttctccaaacagctggtaattactaaatacagaattgacttttgccttttgattccaaagatcatattggtactttcatgtgtgggtcccttcagccagttcctacagtgaccctgacccagctgtaagtcccctgaggtctctagagatatagacagtgatggattagaccctgttcatagttgcagatacaagacatagagaggtttctagcaataatttttttagttatatattttcatagggcttttgatttatgtaacctattagtatatatttgttattccagtagagttaatacattattcaaagagattccagtttttaagccttttctccgtttgtctaagttgttcattatgaaatgattggctagaatttgaaagtctttacctacagagagattctgactggcttgcttggtcttggaaccctagttatgagtgcattgtcttgcttcctggtgaactttgcccagaaatagttaccacctcattttttttttttaaatgaaagctggataattaaccctcaagatttcttaattaaaagattactattataaattgacccacagggagttaatacaataaaattatttttgatcattttatatgaaataattatggggcaatcttctgtaatcttgagttgaaggggttatcttgcttaatgttaataacttttgatacaccaactaccttttaaaaattaacgttttttttttttgcttctgtggaagggaggctgtattttgtaggatttacagtttacatagttattgttttatatgatgtcagttggattaattatgttttgagtggaaactctgtttggttcaaccaatatttgaatgctaattttgttctgtgaacaaatagaaatacagagaacagtaagacatgactctttccccctaagtaaaggcttaggttggagttttcaacctgggaattactgacattttgagccaaataattgtttatgttgggtgggggagggcctacagcggaggctgcctgtacattgtaggatgtttagtaacatccctagcttctacctactagatagatgccagtagcaccacccaagtcgtgacaatcatctttgccaagaactttgaacctctacctagaaacagttcatagggctcaaaaagcaaagtggcctaggacccatgtagttaacaagcttaccctgttggagaaccactgcatagctgaacaacatgggtgagactagtgtcagggtaaaggagctcttgactggagattggccgtacacagaaaacaaagtgagtgttatggatatttggggatttaccttcattagggcacagttggttagcgttaggtgtacaccaacattattccctctttagaaacagccatgcacgtaacattttagcacatctgaagaggcacttctattctaattacctaaaattcttattatctagaattacatgctatgaacaacagcagtaaagtcagaagccagaatctatgtgatgttatctgttttgcgatcacagttgtgttcttctcttagtttatttgaacaagtttgtgaaaaaatttttgtgcttatgtaaatactctttgcttagattttttggtagaatgtaaatctttcccacacagtgcaatacccctcctgcccaagggcgagatatagattgtacagtttgttatttctgtgttttagggcttattcctctgtagacatgtcaaaaagacatccgtcgggggtaaggaatgcattagcaattcaagctgataatctgcatggtgagagtccagataattttttccccaggtcacataggcagctctgcacaagtctgttaaacatatgctagttttgaaaattaaaataagttcccatcactcaaggcaatgaaacgtagatgaattgctctgccagattgactcttagaactcctgatgtgatgtggggctagacagaatgggatgtttgctaataaatcagggaggtagtgattgttttccttctttttctcccccacccccgtcaggacaaactcacattctgtagcctggtgcactctaataatgcctgttgaccttggccatgaaagcactctagactcaccccctaaacaccgcaccgaatgtgctcatccttgaaatttacaagccttagaatcttccctacctccactcctgtttactgcctcctgttactcctggtgcttccagtcagaccgtagtcttggctgtgcagtacctttaggagccctcaaaaatgtttaatttcttttaaaatcagaaggaaaaataaagaacaagataataatcatgaatatacaataatgaatccagcctgacttagagttgtctttataccaatcaacagagccctaaaatatagcttttaatgtttttttaagagagaaagaggcccacgaaagttgtcctggggcccccgcatcctcctcatacactggtgggatgctgctcttgcttgctttggaatgtggcagcagctcccagtgacttcacacgtttattacaaattcaaggtcatttggacgctagccttgtgctacctttcatgcttcctgtccgacccatactcagcctgggcatgttttctgctctgatctttggtctgccttccttctccttctccaagtcaaaccagtcactctttcctgagagctcttcggtgtacccttgccagacctctgcattaacactccagcacctttggttagccaatttggccttatttgtgtctccaccattggattatctgtccatcaaggtcaggaatgttttcgggttaccccactgtccccaactttgaatatgttcactgcctggaaaatgtttatctgaatataaggcatcaagccagaacttgcccaaaacttaacctaggactcaaacagctttgaaatcttatctgtgtagagtgggaacggcatgtgtttgataaccatcagcatttgctgttttgcttagccatcaacaatccgtttctatctcttcctcatagtattttcagctgtatttttgtacagcagtcattcacgttaggtgttaggttacactgaaatctctgacaaccagttctgtgctactgaaggcttttagcagcaggattaaaaaaatagttgattgcacattcgaagtctcactgctcacactgtttatgtaattcttggagtccagttagatcatctgatttttaaaatgttgcctgaattacaaaggagttcaggaatgtgttatcaaagaattaggaaattaacattgaaatttattgagcaacatagctaataggttgtcttgctttttaagccttcttgttttctaggaggagcctgaagtccgtggacaagttgaactgtagctggtatttaggaattggtaaagacagaggtgtggatgctatgttttcttttctctgttaggaaattactctcctggtgccacaataaaaaatttcacaggtatctaaagtggaatttattttgtattgttccacacctttgtcaataattacattttctaccttctagtttattactgttattatttttcatgccaggtgtttcttaattgttggcataagtatttattgaatgcttatatgtgggagtgagagagtcaggccagtgctaaagagtagggaataacccctagacagtgaagtaacttttgtcttgtttgcacattaaaaaaaaaaaaagattaggaatccttgctctatatactagaaatgtttgatgttctcttttcttctcttcaaacagagaaaacttagatgaatacttataggctctactgtcaactaactgcaccctcctaatattggcgtctgcatatttttaccattgtcaatatcagattgcctctgatgttgtgtcactgaaactgatagtaacattacatccaagagtaagactgcagtgtgatttttggctcttggtcttctgttctttcggcaacaattttttataaatatagtcaagaaaatagaaataagagtcttcactgctacctccccttcagaattattttctcctagtattgtggttcctgatagcctttattcctatagaaatggcaattcgaaaaattccttctgtgaatctgagggctctacaaagggagagcttctttgatagtgctttggtgtaagttatttaagaaggacaatctacccaggcttatcaagcaaataacctggaatttaaacctggagtattctttagtgttccaagtctgcaggaaaagaagtaatcttggcttaaactaaataagttaacagaatacaatttgaacaatgaacaagaatgctgtttgaaaattatcttgggtttttatgtcaagttaatattctcactgaatttctattatgtttgtaaagcagctttctcctagaccaaaaatcctagtaataaaaccacaacagtatgagagttataagcacacagtaaaggctgatgagtaaatgttatgacactttgaaaggaaataaaccagacgatataatgtaaatatcctttgtgcttatcaaaaataagtgacttcatgttctgttcctgcaatatttctgtaaatctgctaaaaatagaaaggtaaaggtctaagatcataaatctctgatgccctttccttaaaagtaaggaattcttgtcttggattcttatataatatacttatttataatctcacttgttctgattgcaggtggcctcttactatctttacatccatgtgaatgtgtgtgctttgatgtgtacatatgagagacaagaacaaaagtaaatgtcaaatatccgaattcctgtttcagtgagctttcacggagtaaattctttttgtctacttgcctgtgatctcttctaatatgacttgcgttaatgacctttaagaaatcttttaataaaataaaaaattttattaaaatcttttaataaaaaaattttattaaaatcttctaataaaaaattttattaaaatcttcttcatacgtgttacttgaatttactcatggcaaggaccagttagtaccattttatgaaatcacaagctcatgggcttgtgataaaacatataagtgctttaaatttggcattggtaacggcaggccgactcacttgaaaaatgctctgaactgctctgcctcatgctggtgggaagtcagatggaaatgactttctagagagtttagctggcctccaagcttagtgggtactcactctccttatcccccgatagctgctctgagattttaatgcacattgaagacaatatgataacttaacctggaaaattagcattttggtaagggtctttaacttcattagtattttcataccactttggtattagaaattgtaaagatattaaagggtatggacaatgtggaatgtatgtaccagactcagcagtgtatactgactccctcactatagcccagaactggaaatcccgctaactacctctccccatcctagcctgaattgccctctccacctatgttggttttacaatggcctgacgcctgaaagctggtagaaactgtataggaaaatagggttgggataaatttctgggctgacaaaggatagaggaatatgcttctttttccccttgtccaagtatatcagcaactctaagatgcagatttatcagtatggctctactgggcatgttctagttaaatggtagacccactacctcttctggaatcttgttttccattatattcccacctgcagcttttcaaagacttattctcttctctaatggtctcttggttcttttttttgcccatgctctacgttccgagtgggtcaacattgcagtgggtcaatgagaagaaatagaggggaaaaataaaagaaccagaaagaaacctgttaagtttgcacttacttgtgcattaagcatattagcgtaagccttaaactctagaaaactcactgtagtgctgtaaagtaccactgataaagtaaaagttcatttttatgctgtgtcgttatttagtgatgaatatgatattgcataaaagatgaggatctgtaaggccaggcgcggtggctcacgaggtcaggagttcgagatcagcctgaccaacatgatgaaaccccatctctactaaaaatacaaaaattagccgggtgtggtgacgcgcgcctgtaatcccagctactcaggaggctgaggcaggagaatcgcttgaaccagggaagtggaggttgcagtgagctgagatcacgctactgcactccagcctgggcgacagagtgagactccgtctccaaaaaaaaaagatgaggatctgtgtataactgccaggtgttgtgtgaggtaccatgaataacctggcaatatcctaactgtgcaggtatgaggagtgacccccaggaatataattgcaattaaacttgcaaattatgtggggatactctatttcagggcaataaaataaattatgtctagagctcataactcttacacatatttggctaggtctatgcagcaaaacccaggtgataactgaggctttaactttgggatttgtttggtgctgactctgccacatggtgaaatttggtaggatctcagtgcgagtgtcacatgatcagtctgcttgacccaacatgccagaattccatttctcagcccactctcttctctgcatacatacctacctcccggagagggctgggcgggagcctacgtgtggcaagagccctcactgcttttgttacacagatttcaacacatatggcttgatggagtgtgattgcagtagcatgaatgtttggtgatgaaatttgcatgtcctttgctgggagaagtataattataagatttttgtattcacatagccacatgtgaggtatgagcaggaacggggtctatttaatagcattagattgctttcagatttgaaatatttccttttagaaatatattgtgtaaacaaaatatgtttaattttttttaaaaactatgcctttgtacaaattgtttatcatttgcagaggtctaaaaaatgtaggagaaaagaagctcacaaaatcaatcagatctaaagattgcaaagattgattaccatctccttaaaagcttcagtacatgtgtttacagtatcattctatttgcctctgctcagattctttccaattctaggacaacccaaagtgtatagatcataagccataactgatcctaccttacataatacattaaatataaaatatttatggccaggcatggtgaccagttctgtaatcccagcactttaggagaccaaggcaggaggaacacttgaggccaggaagttgagaccagcctcggcaacatactgagaccttgtctctacagaaaaattagccaggtatggtggtatgggcctgtactcccagctgcctaaaaaaaggcaacttgagaaagtttctaccttctgaaacaatctatgccttgattctatcacttagtattttagttattcctatcaaatacatgactgtgttaatttcttttgccacaaaaatgctgcaaagccacaaactcactccaaaatttagtggcttagaacaataaccatttattatagcccacaagctcaagggtcagctgatcccggcttagcttggctacatttgatataaaacagtagaaatttagaaattgaatatatgtagaatatctcttgtaccaaaaatgaagaggaataatagattttgatttttctttgttgtattctgtgctgggtgctaatctgtcctagctgtcagaacaagtagaagccatactggaaaatcatttatttgttactatcaaatttatttcagtgaatgccattcaaaccactctctctgaggagcccagttaccaagtcctccaccttgttagcaacatggacttaaatgcactaattctagaatgagatcttagcaaagtaccagcatttgagatttgtgcaaattgagctcttaaactgtgtgtatatgtgtgtgtgtgtgtgtgtgttcattctagcactcccactacataccatacaagtagctgtatagcaggtatatatacatgtgtatatgtacataggtaggtatatgtcaactgttgaaaaactagaaaatacacattaaataaagtaagggttgataaacattagtagttggaacattgggagatttggacttctactttgcagattcagttggctgcattagatttaaggaaagaactaactttggagaaatttgtgtttgcatttcaggagagatttcttaaagaggaaactaccagaggttagtagatattaacatctagtgatttaaatttgagaaatgcaaattagacatttaagctgtgggtttgcttcccgttttacttgctctaaaagtaatttttttaaaagccagtaacaaagacatgcaaaatagtactgccatgggggaaaaattacttgaaaataatattcaagattgaagaattaaaaaagcttgacatctagtaccaggaatgccagctggcttgttctgtcaaaaagcaagcatgtgctttggaataacactcttgagtagactctaggcgggttttgagcccttctgattatctaaatagatgtggaagtgacttatcttggtttttctgagtcaaatgagataatgagcaaaggccttagtaggtctttgatttttgcctctaaccctttttctatctgcatgttcacaaggtcaaggctgatgagatatggcaatattgagagagtcagaataggataaagatctcaaatactatatatatatttttttttcatttttttttccctttggtgactgtatgagacatgtcagtaaaactttaaagacaggccaggcgttgtggctcatgcgtataatcccagcactttgggaggccgaggcgggcagatcacttgaggtcaggagtggcaacatggcaaaaacccgtctctactaaaaaatacaaaaattagccaggcgtagtggtgcacgcctgtagtcccagctactcaggaggttaaagcacaagaatcgcttgaacccaggaggcagaggttgcggtgagccgagatcaccccgctgcactccagcctgggcgactgagcaagactctgtctcagaaaacgaaacaaaacaaaagacacacagaaaaactgtaaagacagaatgaaagagatgaactttttacatctcgctcatttcatcacatactatatagtatgtgtatggtttcatatatgttagtgtgtgtgtatgtatatatatgaagttaaaagaaaacattcaccttttaagactaaatggacattgactagattgtaaactgtttttgaggctaagagtttgtttgccatgcataaggctctattttttgtaattccacttttatattcatttatatcagtcctagcagtagatgccactcttactgggtcctgcctaaatgcatgcttcaaatgttggttattaatttcacgagtagtgaataacaaagactcctattgagggacctcttgatttcctactgggcaccagcagcaagcatgacttactggccttcttatgagtgggtaggagttttgggtcaacttgagaacatctatcctttgagtagtaaaaaagcttggtattaggttggcacaaaagtaattgcgatttttgcaccaatctaatatcaacagaggccgtgaaaaacatcaagggaggatagcttgtaattagaagccagatcaacagtgacccaaaaagaatttcaggtttccaggagtgaaatatgtagattactcctctgaaaggaattgtttttctcctattcgctttcatggcaaatcattttttaagccgaaactcaagctctgaaataattgtgtagcaaatagtggctgtgaatagatgtggcaactctccacaagggtaaatagaaaccacttgcagtttcagtcatcacattttatttttcttttttaatagcttctctatttttgctcaccacaaatacatgcacacacacacacaggggcaaagccttggaaaattgcaattttccattttaatttgagagacagcccggtcacattaacagaacccttgacggaataggttgaattcccttctctgtccctataaccccatggccttggacatatccttacctggtgccctttcctccctcttatggtccacttttgtgattctgattttaatttcagttctctgttagtgatgaaatgagcaactgcagatgttccgcttacactggaaatacttttttggcatttaaaagaaaaccctacagatgaattattcccctgaaaggggttcactcagattttctagattatgattctagaaaatagttctttacatttgacaatggagaatttaaatgttttaatatgaaaatgtaaagcactcttgtggggtatagttgaattatgcccaggttaagggaatccagtatttatgtcaggaaaccatggatgtgatagaaatagtatcgctacaaagctgggcacagtggctcatgcctgtaatcccaacattttgggaggccgaggcaggaggatcacttgaggccaggagttcgagaccagcctggccaacatggtgaaaccctgtctctactaaaaatacaaaaattatctgggcgtggtggcacaggcctgtagtcccagctacttgggaggctgaggcaggagaatagcttgaacctaggaggcggagaggttgcagtgagccgagatcatgccactgcactctagtctgggtggtggagtgtgacagtgtatccaaaaaaaaatactgagattatgcaagaatctgactcgaagaagtttgaactgattaaaaagtaccaaatacttcattatatgaggccagctatttagactagtcagcgggtggttcaaatgcagaaaacagatggctttcattagccagaaaccttaaaattacataaatccacggatgcaactaagctatggatctgtgccctctccttgccaaacaggacctctcagctagcaaaacagagagctccttgttcacttttccctcctagttgagaccctgttggggaggaatgctgccaagcctgctctataaggaattttgatctcctagatgataacagagagaaactttttggagaaagggaacaccctgtttgaaaggacaacaagagaacttgttcaagaaggtggctttgcatttaattgaaaattgtagcaactgtaggcgtagggtttccagattcacatctgcagactggtccagattaggtatatatgtttatattcgtttatgttatccccttaagcctcttttaaagccatttctaaaaattgctttggaaagtccatttcacttcagtattctttatattgtggctcaaaaatattttttttctggtaacaaaaatattttctttctgtttttaagacttgtagcatttttaagtttgatatgtacgtctctgtagttcagagcacttggtaaacagcctcttgcttttgaggcaatttatgaatgcttcattgtttttagctggttattttgttcattgtcaggaacactgttttcccatgggaaagcatctccagttttatgatgtcagtggcaagtcattcagtttacaagaattaccttcatattcagtcttagaaaagcatagaccacaaacggccagttatatcacagttctcatcttttaaatgttgtcttagatttttgcaaagtaatcttaactcaccttagaatagtgttaagacataaatagaactaaaatgtagtagttaagtggttatatttcccatctactaaggtatttatatttcttttcttttagaaaataaaaatgtttaaaaaattaggaataattatctttaggatgactttgtaagactgtgcttttttactggcagcaaatacctgccagatttcaggtatttggcaggtaaattgaatcttaaaagatttcaattttaagagtgtccatattaacagatcctgaataggaccctgtgtatcatttattaagtcatttcttggaggcttcactcaggaaaagggagttaacccttggatggcaatgtttaatgtggccacatttccttctggctgaatgccagggagtggctgcgcttagcaaccaggctttgtttcataaatgggttatttgatgcaggtgaggatgccgtgagttgtttgtcttgttttaattcagggagacaggcatatgtagtgaaagcatggaattgtttgcagatgggcttcagtaagaataggaaggtttctggttcaatttgtatctccaagctaattgctctgatttccatatacacatctggtgttggttcggggggaaaaaattttacttgagaaacatggcttttgtgagttgatatttatttgtgaagggcctcttgtaatgtcaaatgtaagaagatctatacacacaaccaattttacaatttctaattcaacagcttaccctattattgaggattcgcagtttaaattattaaatgatctccacttgaagaaaatagagcatgttaatcatcacgattctccaaacatttatttttaaagttaatattaaatctcatctggtggaaaacctgacaggaactgaagcatatattttctagtctaaactctcattgttaaaatgaagacaacatgagacagttatagcgccgtaatcaagttatttgaaaaaaatgttttaaaaattaccactttttggtagtcaacatacacacatatgccaacagatggcattaaaaaatggcaagaacatgagacaattatagggtcataataaatttatttgaaaaaaatgtttaaaaaattaccactttttgatagtcagcatacacacatatgccaacagatgacattaaaatagctgtaaagtcaagaagcagggaggatgacaaagtgaaaaatagaagaaatcaaaggaagttaagtcaaaagaggaaaaaaaaatgaagcatttacttggtttgtcaggtagggtgatccagtgtattttgccaaaaactttcctggttttagcaccaaatgtctcagaacatggcagctgatgacctccctcacagtgagtgatcccagagagcaatgaagaattgtgatgcccttcatgaccttgttttggatgttacacatcatcatgcccttcagtgacctttctggtagcaaagggtttgtttttaaaagagttgcagcatctttaagtctaatatatacatgctcggaagttacaccatcatcacttctgctgtactccatttgttgcacagacagaccctgatacattgtggagtttcccagggtccatgaatagcaggaggcagggactattgggggccttcttggaggctggctaccctggggagagaaattgtcaatttcctctccttgcggggaggaaatggaatcaagtgcatttgtattgacaagaaggtagaacgctttccttagacattgtaatgaacagattgtggataaacaaaagtacagagagagtttgaggcagaggaggagactgtttcaacagaatatttaccagctatggtaaaggctcattagtgtctccgtacagttaacaacatgctgccaagactggaaatctttgggacaggaatgaattcggaaggtgaacagaataaagtactgtgggaacaatggcgattccattagtggattgtacattccttacgggcagggccctccatagcatctgatgtagggccttatccacaggtatctgattattatttgactttctttaatgtttttgcagtgttattatctatactacttatttcagtaagattgacaacatttgcatttcgatttctaagatcaagacaatgaatttcctcttaatccctcaggaaagctgtgaaatttaaatttatagagcattctacttagcctgctgctttgcatctgtcagagaatgagaccccccagtttcatggaagtcacaggaagtggcaaggggctcagatggagttgaggggttctagctatttctgcagatgatctggatattttggcatcggctgctttgacttaaccatctggcaatgtaaaggcagaatttcgttaaatattggaaaagttacttgaaaacatggctctagagattttgccagcagcttttgcactcatgacttggttcaatctaagacctgttttgtttttttgttgtaaggacctaagtcctctgttgggttttgacgaagtatgtgtaaaaatgactaaaatggccagaggtatcttattttacatttatgtgggaagaaatgtttggaaactgtttcatttctttaactgaaaatttctcagtgcaattttagttggtgtttttcctcctgtggacagtttttaggaatgatacaagttatcgtggaatcacccagttcttgagtgtgtgaacgaatggcttctgctggaagttaattcttcttggcatgggtgtctcacatttccccagcagctggatttgacaagggagggcctatcatgattaatatgccttctaattgattggtttaataacacctttactcctgtggatatatttttcatttcttgctgaatttttttttctttttgagataccagaacctgttaagtgacacggtatagatatttcaggacttccattttctcttttaaaaatatttttgtaaaggtaatgcctgtacacagaagagtttgaaaatacagaaggcaccctttttcatgaagttattttgtgaagtggtctattgcctgcaatggtaatagctaggaccccttacttactacccagcaggcactatgtagagctccaaatgagaaaatgttggctccttgcagatggttgggagaggagacaccagcactcttaacagacttgttaagagttgagactgataaccagagaatattctgggggaaaccaggagggatcgccaacatactcagttatatttgtggatggtgaattctacagtgaatttttctgttcaaaatcataatacagtcacttgctaactaccaacgccatacttgctctcagtgctgagaggtggcacaaatattattttcagtcttggtcatcaggcagggcctggcaggcatcatgctctgtgtgagtcagtggagtttattataagaatgcggtagcctccacagtgattatatttattataggaaaacgtgtaattttgttgtcagaacctttcagcaggtaccacaaaatctcatatgggaaaacgtgtaaatttttcatgaataaattcctttcggtattggtaatttccttctctgttttagtataaaagaaagcattgccttataggtggctaagaacatctgtagcatacataacacttaatctaaaggagtgttgaagaccgggctgattcctaattgagaatgagcaagaatagaactctttttgatagttatccctgttcttcctccaagcctctgccttggagctatggatactataactaactgaagcttcttctttcaggtacccactgatggtaatgctggcctgctggctgaaccccagattgccatgttctgtggcagactgaacatgcacatgaatgtccagaatgggaagtgggattcagatccatcagggaccaaaacctgcattgataccaaggaaggcatcctgcagtattgccaagaagtaagtcctgtccggtggctagcaattcacgttggatcacatgcatttgttttcaaaaaatttaacttcttgtattttgcatcagtattttaaccctacagtaaaaatcttggttcctaatgattcaccataccattaatatatttatttgcattaccctatgatatacatataaatgtttttaaaattatgatgtcgtattatgaccatcactaaacagtagtttaagatgtcacagcacttttttttttcctcactctgtcacccaggttggagtgcagtggcaagattatggcttactgtagccttgacctactgggctcaagcaatcctcccacctcagcctcccaagtagctggactataggcacatgccaccaggcctgactgattttttttaatttttagtagagatggggtctccttgtgttggccaggctgtctgaaactcctgggctcaagcgatcctctggctggacctcccaaagtgctgagattacgggtatgagccaccatgctcagccctccacactcctttcatcttcagtatatatctcaccacggctctacagtcaaggtcttttggttaaaagtgctagcattaatttttttctgttaccagcttgatacatattttagttcatttgtatctgtttgtattctattatagtttggttttttcctcccttattaattttactttttgactatcatgttagttctatgaaatatactcagaaagctcacttttcactcattctctattgataaacattttcattgttcctgatttatttttttggcaaaagaaaatacatatttttccttcttgtacaaaaaaagtacaaagttcactgttctgcactttgcttttttttttttttttttttttaacttaactttgtatcctggaaatcatcctttgtcatttcgtggagatcttcatttttgtttaattctttgtagtctttttgctgttactatacagggtgctcctttcttattcaatttaaaatagctggagttccaggcattttatctcacacttcttagatagttatctctgcatgtgactgcatcttaagaacattagaagtaattagtcttatgcttgttggcaaagcagaattctcgacactcattataaacagcagatagcctggcaacattttcttttgttgtaatcctttttgtactagaaatttttctttagcctacttggataatgaatgtttgttgtttaattaatattactattctattgagatccttttattttaaattgtaaatactaaaattattattattaaaaggtttaatttgttttgatagcgctctgtttaagaaaggacaagctctaattactaattggtgttttgagaagcaaaaagcatctacattatcacaatatattacatattaagtaatttttatcttgaaaggagtatgaaccatgatgtgaaatgatgaatagtggaaatcactaatacttaagttcattatatgtattttttgttttgttttgtttttttttgagatgacatcttgctctgtcgcccaggatggagtgcagtggtgcaatctcagcttactgcaacctccacctcccgggtataaatgattctcctgcctcagcctcctgagtagatgggactataggcacccgccaccacgcccagctaaatttttttgtatttttagtagagacagggtttcaccatattggccaggctggtcttgaactactgacattgtgatccacccatgtcagcctcccaaagtgctgggattatagccgtgagctaccacgtatggtccattatatgtatttttacaagaacattctgtgtgctgatttactaagtatggattgataataaatcagcttttgcctgggtgtgacttttataaagtgtcaatgttagaaataatatttacattctgctgaagagttcttgtagtacaattgtgtagataagttataaattttataaatcagaactctgtgcatacttatatgtttttgataccatttttttgatatatgcatacagactatgtattctgagtgtcaaataaactttttttaaaggctagaattaaaatttagtttatgacattgaccaaattgtccttttctggtgaatcgactattttgatacatgtgtcatagtttgcatctaagtttttcttcccttagtttcacgtatgaataaccagatgttttcacatttgtatggtggccataccaaaaattactcttcttgaccccaggaacacccctcttttcccgtttcacttagagatcctactaatgcctgggtagctttactttctgtcttagcctgttgtttgtcccagggtgtattagtctgttctcacattgctgtaataaactacctgagactgggtaatttataaagaaaagaggtttaagtggttcacggttccaaaggctgtatgggaagcatggctggggaggcctcaggaaacttagaatcatggcaggaggtgaaggggaagaagacacatgttcacatggccagagcaagaaagagaaagagtgtgaagggagaggtgctacacactttcaaacacccggatctcatgagaacactgtcacgggacagcactcgagggatggtgcttaaacattgaaaccacccccatgatccaatcccttcccaccagaccccacttccaacactgggaattacaattcgacatgagatttgggtagggacacagagccaaactgtatcaaagggttgagcacagagtggttcttcccagttctggactttaccagattgttggtggccaccatgagtggggagaattagccctttgctgtcaccttcctcttgcaattctggtattatctgtcctctgcctaccacccacccacggaagtcttgttggatgatacacaccagccagattcttcaacattaggcgccataagtaagaaagggccaaaacatcataccttgtgagccattttaatggatttgggctttattttgtagcaacaggaagtcactagactttattttttatctatttatttttttctttttttttcttttgtttttgagacagagtcttgctcttgtggcccaggctgcagtgcagtggcacaatctcagctcactgcaacctctgcctcctgggttcaaatgattctcctgcctcagcctcccgagtagctgggattataggcgcctgccaccacgccgggattttttttatttttagtagagacagggtttcaccatgttggccaggctggtctcgaactcctgaccttgcgatccaccctcttcggcctcccagagtgctgggattacaggcgtgagccacccgcacccggcctagactttattttttcagagaagaggagtgattgtagatttgcatttaaacaaatcaccttcttgctttatcactatgtcccctaccatatatcttcgttctcccagagactgccatgctgcagcctctagccgtgtgctgtccagtactgtagccactggccctatgtggttgtttggcacttgaaatgtggctagtggaaactgatgtgtgctataagtgtaagatagataccgtatctcaaagatataatgtgagaaaacctgtaaaatgatcacattcatttttatataggtttaacattgaaatagttatgttttgaatatgttgttaaatacatcataaatgttactgagttgtaactatgtgattaaaattgatttcacttgtttcttttgacgtttcacgtggcagtgaggaaattgaggttccataggcagttgcattctgtttccgtggaacagtgctgttctctgtgctatcccgagccaccagtgactctgagctgtaagggtcttagatcccatgatctggcaagtgggagagggaggtagaaatgagtccctccataccttcaaccagaacttcactgcatgttgcaagtcagggaacaaggcttgtttggggtccttttaaatacatctttcattaaatacatttggatgtaagatgattatatgcctttctagaaccctgtggtgctctcttcctcctcagacataatgtctttggatactaagggtgcattgatgaacagaacacagggcctgttcttcaaagggggagaaaagcttgtaaaatcataattttagcaatctaaaaactacatggtgacagtgacactaataccatcagcattgagcattcacaaagggtcacaaagggtcagctactatgctaagtacttgcactcattttacccactcagtgacacctgtggagaagaaccgaaggaaagcaccttggggaattgcagcattgaaggcaaacaaagagagacgattccccatgagggagatgagcagtggccagagagataggataggaagtaggaggcgttacatgctggaaggcaagccatgtaaatttctaaatgaggggaaagataagagtgcaagcatgatgcaaacggaaagcagttgaagtgtagtttttgacatggtaaaatcatgtctgtcatgcagactgaacacatgtcaaatattttattcaattcattaatgagatgaactgtaagatgtgaaaaatggttcattttgacttggagagatttaaaattccttccccagcacacttgagttgcatggctatgaacaggaatcatctggaattatctggaatatcgtcaaattatttccatggtacaggaacacttgcattgctatggggtgtctgcagtatccatctttacaaagctctaagggtgtggaatagcttgtaaggatgtaagtaataagggtgtaagaattttaagggtgtaagtcgtaaaatagcttatttagtagcaagtcaactggaggaacatgctgtagaatcagataatcctttccccgccaccctcagggtctgcaagacaacacctgcatttcaatgctaggacacccagcaatctcttttgctcatatcttgtttttggacatttgtatgtgtgtgtgacaaaacattgttaggatctggcaaatagaaggtcattgttgaccctgtggaatagcatggggagaagttacgttgtagtccattgcaggaaaaacaacgtgggtcaatggtgagtcagctgtggactcctggaggaaagacctagaggcaaaaagctttgaggtcattgaagacaaaaggaaaggctttgtgattttgatttttaaatggaaggaatttgggcctaaggaagcttaaactaaactgtgggaaggactgatacccatcctaagcactagttgcaggtatctcttaagaactaggttttggccgagctccgtggctcagacctgtagtcgcagcgctttgagtgagaggatcgcttgggcccaagagtacaaggttacagtaagctatgactatggtattcagttctgtaagaactaggcagaaaggagatccagtggatatgtgattgcctgggtcttggaaaggggagggaacatctccttttctgaggaagaatggggagatagggtgggttaattaggcagtttcttttgccaggtgataaaaaccccctaaacaatttgtattttatatatggagaatattttctcccactgatgggaaggatcgtagtgtgggggatgcttacccaatttcttaaaaatgtacacagaaatgagatccctaggtgctggaaccgagggtcagtactgcctagaatttccccattagggtctcttttgtttctgcttaccttcctgctgtgtgtttactccttttctcctgctaagatgggtgtcctcaaggagaccagggatgttggtagccacgacctctggtagtgttagtcctggtttggcatcccaactttgttctgcccatgggcattatcagggagtgcttctggttggcactgctttgagttacacgtctgcccttggagccaccaccgtatctgcagggactcagtatcaggactagcccatcttggccttgtgggtgtggccgtgtgatgtggggagaggagctgttgccagaagagggatgaggaatggcatgggcaaaatagaagaatgaccccagtgctgcaacacagtgggtatggattagaaaaggcttgtaggctggacagggcgaggtgagggagtgcatcatgcattaggattttaagtggctttttggggagtattgagcaggtggcaggggagacaagttcactcagaagttttagacagtgttgacattttctttcaaattgtgcatcttgaattctctagaacattctttatagatatttcaggatcttcctgccactttccacattgtagctattctggtgtttttcttttataattagaaataatgaatagttctcatttgtaggcttggattttcatgcgtgtgttggaaagtgttcgttttgccttttttttttaacttcatgtttttattttttaaaccgtattgatggattcattgctaggaacggcaaggaaaagaatactctcacaatgttaccacgtttccttctcacaggttttataagttgtattatttttatattttcaaagttataatcttaccatctcctctgttgccatacttctcattcatagggtctgtctttaactggactcattgtttacagctagtcttttcatcagatcatctcaaaccctgtattacattaatattttgattccgttttgttggatgactttcatcttaatcattcttattgttgaacaatgtttttcttattattgaacaattgcttcattaggtatagaattcctggttgatgggtgtttgattcagcaccatgaaaattcacggtattctggtatctgtcattgggcaaattcttcttctttttttttttttttttttttgaaaaaaatgcgtggaaaccattagttaccattgacagagctactcatttaatgattttttttttctcccaatagtggtggatgaattttttactttgcgttctcactttgtgtctctcatgaccaaaatattttagagataactagctggctaagtctgaggtggctgttaacagtctggtcctaggatagaacaaaaccaacagaactcatcaccgtcacgtcgttttgactttttgctcacaagtttaactcattgtttaatttgtttttccaaaggattgctttgcagtatacatgttggtgcatagcttaacatgatgataaatacataactttgactgtgaattatctactctgctcctttcatagtctcatgcttctctgaatttgtattttgtgttactgggttgttttgttgttatcattcatagtgttttttttgcccttgattctttgatccaggttttggtcaagggcaaggttcaagagaaaaagtaaaaacacagtcttttatttttgctcttggttataaacccttgtaaagtttgattgagaagataacttggatcttatggtttaaattgagtctttgtttaatcccaagtcttccaaattctttgtgcttatgtattctttcctctttcccaatcgtaatagttttgcttctgcctagtcattggtcaaatacctgcctttcaatgcatttaaaaaatattttgtgttagcaccatttgagatttttccccccttttttttcaagtatgtattgaggactgttatgggatgaatgtttgtgttcccccaaaatttagatattgaaaccctaaccccaggctattcggagatggtattcggagatgatacctttgggaggtgataactgttagatgaggtcatgagtatgtgcccccgtgatggaactagtgcccttataagaaaagataccaaagagcttgcctttttctccctgctcaaacgaagaagtcacataaggacacagcaaggaggtggctgtctgcaagcaaggaagagcggcctcaccagaactcggtcatgctggcaccttggttttggacttccagcttccagagctgtgacaaaagacatttttgttgtttaagccattcacagtaaggcagcattttgagctaagacaaagacctactgtggcttctgtaggcaaaagccctacagacccaaagtgttgtgagaattaacatttctagggatcatgccttacagtggattttatccaacacttagctctgacctagagcacgctagtcgtcgttaggtaaatgcttgtggatggtagtttctggcacagagattggagcggtaatgggcaggagttctgtatccagcttatgctgagagagcttcccataaaatggagcctatactttccttttgcagagaccatttctatccattgatagaattcttttttttctttttcttttttttgacgggatctcactccatcgcccaggctggagtgcagtggcatgatgtcaacccactgcaacctctgcctcctgggttcaagtgattctcatgcctcagcctcctgagtagctgggattacaaggtgcacgccaccacatgtggctaatttttgtattttggtagagatggggtttcaccatgttggctaggctggtcttgaactctagtgatttacctgcctcggcctcccaaagtgctgggattacaggcatgagccactgcacccagccttccatcgacagaattctaaagacatgtttaggcaagagttggtggaatgttggcgtgtagtccagatttgccttcagtttgtttttatccgcttcaaatgcaaaggccatgataattcaatagtaaagtcataaatccatagtatgacttaaaatatttggttgtaatattacaaagtatgcttccaaacacattaagcatgcaaaatccttatattgttctttttgtttagtgtttagggtagtttgtgtgaatcatagatgaccacagtagactgttgagttgttattttcttttgacattctttgatagaaaacagtgcttttcctctgttatttatactagaagcaaaaagtatctctcatagcattatggaaacaactcgaatacaactacgtcaattattcatcttttttttttttttttttttttttttgagacagagtcccactccatcaaccaggctggagtgcagtggtgcagtcttggctcactgcattctttgcatcctgggctcaagtgattctcgtgcctcagcctcccaagtagctgagattacaggtgcccacaccattctcagataatttttgtatttttactagagatggggtttcaccatgttggccaggctggtctcgaactcctgacctcaagtgatccacctgtcttggcctcccaaagtgctgggattacaggtgcgaaccactgtgcctggcagttattcatcatttaacagcataaagtggccacttgctttaataaactattatagtaccaaaattttggcctgaggaatttataaatataaatagaacaaaacaaaaataatattccccttgaaacatattctaaaaccaggggctaaaagttagaattgttagattttattgtcctgtttctttgggatgaaatgaaattttttaaaaaccatagttttggccgggcgcagtggctcacgcctgtaatcccagcactttgggaggccgaggcgggcagatcacgaggtcaggagatcgagaccatcccggctaacacggtgaaaccctgtctctactaaaaatacaaaaatatttgccgggcgtggtggtgggcacctgtagtcccagctacttgggaggctgaggcaggagaatggcgtgaacccgggaggtggagcttgcggtgagccgagatcgcgccgctgcactccagcctgggcgacaagagcgagactccggctccaaaaaaaaaaaaaaaaaaaaaaccacatagttttacttaaaccaaaggctttgggattccagaagaataaaggaagtgtacttcaattctacatctcaagaatctatttcttcccaaatttaatacaggcaaatttagtctatatttattgggcactgttaggtttttgtgtcaggtgttgctgagtggcgggataccattcttggcccataaggaccttataaatctattaatacaattaaattgtgaagaaaatttagaaaattgcaaaggtagaatgaggttgcaaattggagggtcttattctggagataggtggaagctatggcagatttttagcatgaatgctttctggtcaagacacttttagaaaaattagcttgtttccaagagtagattagattggggagagaaggaattcaaattacaaaataatagtgtgaaaagcattgtgggagatcatcctgtccatcccctcattcatgatatcctgaggtgctgtattaagggcatcattgctctttgtcacccgagcagtccaggaaggctgcctgttcagtcttagactgtatcctcacagtcttaaaccatatcctcactttatgatagaaacacacaggcaagtgttgtaagagttacatattgtcagttaaacaagaaattggatgagtccccatactattcttcctcttttaaagagagaacttgggccgggtgccatggctcacacctgtaatcccagcacattgggaggccgagtcgggctggtgacgagatcaagagatcaagaccatcctagccaacatggtgaaaccccgtctctactaaaaatacaaaaattagatgggcatggtggcgcacgcctgtagtcccagctactcgggagactgaggcaggagaattgcttgaactcggaggccgaggttgcagtgggccgagatcacgccactgcactccagcctggcgacagagtgagactccatcccaaaaaaaaaaaaaaaaaaaaaaaggaaaaaaaaagagataacttgaaacaggctcttccagcctctctattcttttaataacatgcagtgcacttcttggagctaggggctagggtctaggggcttcttgaaggtgttgatgtctctggtaacttacactgcagggcaggtctctggagggaactttgaacaggttaagcctcaaatgcaggcagagatttccaattgggaaagttaggtgaacgtggctttatcatctcttttattggtttatgggtattttctctttttcctgttttctttcccaccatttaacattatctgttctctgcctttttaaccttctggctttaaatgaacagttgcttaatctatagattaacaggatcagcaaacaaagcacagcagtgcctgcacaaagcagaaactgcctgttagatgagttgagcaaaaccatttcctttgcccaactttctcctctaaaatacataactgaacatgggattcccagacacgaattgtttctcaacctttctttttccattctacagttgtatgaaattaaaattaaataaaaagcaaacaacagaggtagtctttttaatcttaccgagttggaaggtatactatatacattatcctatggtagaaggtctggtacattcttgaccattattactttgctatgggcacccttcacccttgtaggctgaaaattggcaaatcataggcacgtatacattgtggttttggaatttgaaagatctcaaattcatattgagtgagacagtttttgaatggagggatcaggctgtctatatgtggatatattttatgcatttctggtctgtataaatgtaaggattgctttactgaccgtagatttcttctagggttaaaaagttgaagccagtttggatattttaaaataagaaaattagccctacattgaaagagagaataggaaaatctaggctatgtgtacacatctgcttgtgttttcacaattgtgtcctgtcctatttatttttatttctctcccatctcttccctcccacccacaatttgtttttcattcaacactttgaaattagaatagcttatctatcaaacaaggttctttgacaggattttccaactctgagtatgaaagtgtggatataacaatatatttatatagaatgtcagaagcagagtttggccagattattgggaaatattctaacgccctgcagcattttaccgcctttgcttttacataaggccatcatttggaaacatagcatgctgatacctcccattattgcagtagcgtttcatcagctgcacgctgcctctcagcgcctcattaagttgcaagcagagaacgttttcgttttccagttctctttctcaattaagttagagattgtattttcagtattcctcattattaaaagaatttttgttgagaatagtttaagatgtgatatttctttgtattccaggaaaatttaaagaatgtcattgaaatccagaaacagaagtatatattgtctaggacatgctttgtcttggtttatatgcctaagtccgagtagtttaaaatttatgattaatatactctttgaatgcttagaaatggcatcgattttagttgttctagtttcatcttaaataaattggagtaattactaactcaggattatgatgtgctacacataaaacatttgcagtgatgtctggtacttaggaaaccctcagttatgacatttttcttactttcttcttggatatgttctttgaaaaagggactggtatggaaaagctttgagacgatgaaaatatacaagataggctatctctgaaacaatttggtatagagcatttgattctctgtttcatgtatatattcatatatgctagctgcagtcatgcagacacaatttggatctgggtttttttttttttcctttttcacatgcagttataaatttagaaacctggctgtttcctctggactaaatgtatttatttaaattttcagtgctttaaatgcaaaattacaagcatatgtacaagtagaaagaatagtaaaatgaaccctcccatctatctgtcactgaattgcagtaatgatcaaatctagtcagtcttgttcctgagtcagtctggaatgcaggttttttcccttaactattcaggttctccagcaatcctggcaaaacacatgcgggtttcagctcatctctttcagtgacctgtaaattaagatgtgctaaagcatcacatgttactcattgacgttttgttaatatatttaaaacattttattagtaccacataatttttagcgttttcaaaaagaaataagaatttggctaaaggtgaattttaaaaattgaatgactaagtagaaaagtaggcaaactgttttcagaattagtagcaatttccaattccatttactctgttcattaactttgttttcagccttttgttagccatgtttgattttgtgtttttgaaatacctttggtcattttaggacttttggcattaatcacctgtcttaggtggcctgtttacaaaagggacttttcggttctccatttgcccttaatgttgggaatagagacaaagtttctgtaggactctgacaacatatggctttacaaagtttttttttaatatatacatttctcttcttggctttcttaaatatcatcaatgtcttttcttgctttacgtatttagcaacttaaatgtcatcttgtctgagatcaatatatttccaacttggagagatagtgagaagagagacttcagatttttaaaatgtggaacaaaacattctgatggtgaccaggttttaaggtatttcttcagtagacaaaactacttaggctaccgatgataagcttttaatattaataataattattatatataaaaatattaatataatatgatctaagattgtttctattccccctctttcctggttgttaggatttggaatttcttatgcactctttttttttttttttttttttttctgagacagagtctggctctgcctcgcaggctggagtgcagtggcgcgatctcggctcactgcaagctccgcctcccaggttcacgccattctcctgcctcagcctcccaagtagctgagactacaggcgcctgccaccatgcccggctaatttttgtattttttagtagagacggggtttcaccatgttagccaggatggtctcgatctactgaccttgtgatccacccgtcttggcctcccaaagtgctgggattacaggcctgagccaccgcgcccggcctatgcactcttaaaattatttcatgtactgatacattcactttcaatgataaaacatggctgtatgaccaggtaggtaggctgcttttcagactcctgtactaactgaatgggccccattagcccaagtgagagcttaacttgtcactcttcctaaatgccttcctcagctgagtgcttatttacagtaatctactgcttatagcagatgctatgatttgtataagctgtccatatctacttggaagaacaatattgaaaggcattgagatacttactttccctcaaaagcccataatccaacaactatttagaatatcttatttaagagataggtttataatacccaaagggaacttaatgtatactgaaagtccctgattgaatggattctgaccttaaccagaaatattaattacatgcttatcagacacttactgtgctatcccagggtttgccactgttgagggaacaccagatgaatcatattgtccctgccttcaaggattatatattctaataggacagacagcccatcagcagaataggaggtagcaagtggtcagggatcagataaagtgatcaaggcaagtggaggatgcagtggtaggacagaatggtctgcgcacagagattgagggcatcatgtggtgggaattagtgaactagcatgcaagccgggcctttttcttggcttttgttcaattggaaggagcataaagctactaaaggagcttatgtttagaaatagggcttattgaaggggacaaggcatctcctagaatccaaatgcacatcccaagacttaaaagagttagagggcacaggcaggccctgtcagatccggtctctgccagatccagtcttgtctgtttctcatcttcccttgtctctctgagtattccctgttttcctttcctggactaactgcttcttccagatgcctagtttgagtccacccatggttttttgggggcttttctttgtttttttgttacgttctgtttttgttttttgtttttttgaggcggggtctcactctgttgcccagactggagtgcagtgacgtgatcccagttcactgcagcctcgacctcctcgcttaagctgtcctcccacctcagcctcccgagtagctgggactataggcgcaagccaccatgcacccatgggtgttgacatgccacctgtggctcagacttatgctcacctccagtcaagtttcttccttatctaacgacagcctttgtgtgttcgtgaaagcccttgagggaaagaatgctacgtacagtttggttttcttgggctctaataagctataggggatggtgctgcagagtttgaaatacagtcactaatgagtcctccttcagagagctgagggtgggagcaccacataaaaggagttgggggtcagcagcctcctgatagtctgaaagccaaagatgatggatgtggggctccacggggaggctataacatgccacgttatgttttctgcccttgaggaaagcttcttttcaccaggcaggcagtacagatacaaacttaatagcgatgtgaggcacactgataaataccagaaaacattctgtaagaggggttagcattatttcactgtgtgcagaggaggtttgtccatgtggggggaccctaatgggcgtaggcatttgaagtgtagtctaagggatcttaggtaagagtgtgtttggaacacagtgtacgtatttatacagcaaatgctctgtgtggctataatttaggaaaatttgtaggacttgaggacagcttatttttctactagctgacagaggcttgggtttgcttctgctttaagtataagtatctcgagtccttttttaaaaaggaaaatcaaggaaatagttggaattgggtttcacataaaaaacattttagaaaagaaggggagtatgagagttaggatttgctaatgtttgctgtattagcaaattatttgcaatgcttgtcatattagcaatacatgtatgttttggaaaacacatgcaaattaagcagcttaaggaacttttatctttatttcctatgtaagatttgagatgctgcaaagaaaatattaaaacattgaaccgatacttacagtagtcctcctatatctgcagaggataacttccaagacccccagtgaatgcccgaaaccttagatagtaccaaacccaatatatactatgtttttttcctataggtacatacctgtgataaagttgaatttacaaattaggcacagtaagtaattcacaacaactaataatagaatagagcaattatgacactacgccaccatcactactcttgcactttggggccgttattaagtcaaataagagttacttgaacacaagcgctgtgatgaagtgatcaatggcaggtagcatgtacagcatggagacgctggacaaagggatgattcactttctggactgtgtgggtttgagatttcatcacactgctcagaatggtgcgcaatttaaaacttattgttggctgggcatggtggctcatgcctgtaatcctggtactttgggaggccaggacaggaggatctcttgaggccaggagtttgagaccagcctgggcaacataggatgaccctatctctttcttaaaattaaatataggccgggcacggtggctcacgcctgtaatcccaacactttgggaggccaaggcgggtggatcacaaggtcaggagattgagagcatcctggccaacatggtgaaaccctgtctttactgaaaatacaaaaattagccgggtgtggtagtgggtgcctgtagtcccagctactcaggaggctgaggcaggagaatcgcttgaacctgggagatggaggttacagtgagctgagattgcaccactgcactgcaacctgggcgacagagtgagagtccatctcaaaaaaaaaataaattaattaaataaatagaaaaataaaactcatttatttatagagctttctatttaatatttttggactgaaactatggaaagcaaaaccacagataagggaggactactatagttatgataaaaatcaggaacttaatctagccacgagaacatttgtatttctgatgaaatttttattcttgtctaaaatgttgaactatatttatatttatatctttaaatataaatgaactatatttatatctttataaatgagctatatatttatattttatataaatataaatatttttatatctatgtaaacataaaaaggctttttttcctctctggatgtttactggggttatttaataaaaacctagggatgatattgggaatttttgttggaattttaaattttaacgtgtttgtttctttttttgttttgtttcgttgtttgctttctgagctgggagttggctgtgcatgtggcagttgctttatcaaaagggtcttgctctgcttcagaagaagttttgttaccttgattgctaatgttctcccccttaaataaacctcctgatgttggaacagcaaaattgcattatgtttggaaaatctaaattaataatcccttatctctgaataaaagtaactgaatcaggttgaatttactgcttccattttaataggacagtaggaaaaaactatgcatgggctttatgtggttcaaatttttttttttttttttttgagaccgagtctcgctctgtcaccaggctggagtgcagtggtgtgatctcagctcactgcaacatccgcttcctgggttcctgcgattctcctgcctcagcctccggagtagctgggacttaacaggcgtgtgccatgacgcccagctaatttttgtatttttagtagagacagggtttcaccatgttggccaggatggtcttgatctcttgacctcgtgagccgcccgcctcggcctcccaaagtgctgggattacaggtgtgtgccactgtctccggcctggttcaaattttgtaatctccacatccatctgcatattaacaattgtcattgttggtgttatagagagagaagctgaagcacagaaaataacacgcatgttctagatttcctggtgggaactggaagtaaattctgtgtttggctgatcactgtataaagttctagtactagtctttagggaaaagccccgtcttcatggattttaatttgtcaatttgcaattctacctacttggaaatagtcaacctaatcagttactgccctgttgcaccaactattaccataggaatctgaagatggtatgcaaccaacatgaaaaagagatccttttctcctggtaatcagtttgtaccctacaaacaattcgttggttttaagttgtatagagggaaccatgatgtgaatatgcctgccactgggtttatagaaaaccgatgactcctgaggaaattctcagcagggttgtctttcagtgaaaagaaccctttagaaagatgcagtaactcacactttactgcacataaagtcatgtccctcagggtggactctcaggtgtcatacagtttatgactcatgagtgctgcagctttgtgatctaataaacaagtaaagacggtgggagaattatattcctgtacaaaaagccacttcacctttcattatataggaaaaaagccatgggaatattaaatttttagtggcatttttagagcattttctgtgatctaaagtgcctgcattgagatattaagatacttaagaacaaagtaaaataaagagaagtattaatagcaggatccctttggagctaggttactgtggcagtggtttcaagaataactctctcagcacccaccccaggattctgatttagagatttctttgtgtgttctcttagcatatacctctaccactgagtttatcccctgctgctacactgattgataccttatttttaaatttttgtttttaaaatagacggttttttagagcagttttagattcacagaaaagttgagaggaaggtacagaggtttcccatatacttgctacctgcacacatgcttagcctctcctattataaacatcccccacagaatggtacatttgttacaatcgatgaaccaacattgatacatcattagcacccaaagtccatagtttccctgagggttcactcttggcggtatacattttttgggtttggacaaatgtataatgacatatgtccatcattgtagtaccatacagagtagtttcactgccctaaaaatcttctgtgctctatctgttcatcctccccctgcccccaaccacccaaacccgtggcaaccactgatctttttagtctccatagttctgccttttccagaatgtcatatagtgggaagaatgtcatatagtatggagcctattcagatgggcttctttcacttagcaatattagttaagttcctccatgtcttttcatgggttcatagcccatttccttttagtgttgaatgacattccattttctaggtgtgtaccccacagtgttatttattcattcacagtaccttattttttaactgatttttttggggtctgggactaaggtgaggtaaacaaggcagtcaggaattgagattaagaatttttaatgtaatatttttaaaaatcaaaattactgcaaaaaaactccatgatgaacaaaatatcaactttttagacagagattgagtcacgctcaattgacatcaagccatgcatagttctcctactgccttattaaaatggaagcagtaaattcagcctgattcagttacttttattcaaagataagggattattaatttagatttgtcaagccctctgaatgtcatggacaattgtgagtgaaattccgtgtatcgtctaactccccatggatgttatcttgctcagaaaccttgttctccctccaaggaaggcactacttctcctgtagccttctcaggtcgaagttcttttctcaaaatcctcacagcgttgcccctagaggtgggaatgtcctcttttcctcttcatttcctcttttcctcttcatttttgtttccaaaccactcttcctttctcttccctaaaagcccccctacctcagcttgaagtgcatgctttcagacaaatcactttgctcctccacctgttggtcatctccagacctctttctacctcatcgatgttcaccattcagactttgaagattttagctcctgccttgctgtcatcaggtgtagctgctcatttgctgattcttaagtgatcctaatattgatctcaatgatccttccagtattccaatttgtcagttcatgattctcatccctccagtgaccttgttttcatcattctccatcacccattgcttacaatggtcatattatactccttgcaatgaccaatcactgcaactcctccaaaattttaatttcaattatttgactctccaagtactacttattaccacctcactttctccagtcctgtgcgccatacattctttagcccctggagtgtgatcagtggactcagattccactggtccctaccaccttttacctgtgtctaattcccctcatgttctcacttttgccacttgagattgcatggcccagcattctaatcattcccttgcttataccgtcacttctctattcgttgttatttatctggcaaaacaaccaccctgttgcaatgcaaggtttatgcaagggaatgcacattttcgaaatagatttttatgtttatgtttttctttcaaatctctactcattaataaatagaagtggtttgatatttcacaaatgtgatttaattgatcaagtttcacatttcattctaagtgctcagttaaacaccatgatgtattcacaacagtaatcaaagcaaggggctgtagttagttataggagcaaagagaattcatgagtttatttttatctaaatgacacccttgataacttttcgataagttattttcatgtaaattacttggaataagagcaggatttttatatagaaagctttctatgtgtcatatcctgtaaaatgtttgtccgattagtgagagatagggggaggttgaattttactaaacataatatccccagccatatctactgtaacgtttgtttaggacattacagactattatcctacaccaatttatttcacatcaaaaatcaccccatgcttgtaagaatcctcctttccccctcttgtttctattttagctcccctggaaaaataatattttaagtctaaatgagtacaataaattaaaaagttgcattgcttaatattttgaatggaatagctagatgcttgttcatttgctatctttttctttgtactgaatttctttagcttggtcagaggtagagcaggcttgactcttagtggatagtggtataggttgagtatcccaaatttaaaaatccagagtccgaaatgctcaaaaacccaaaactatttgcatgtcaacatgatgctcaaaggaaatgctcattggagtattttggattttggactttccggattccagatgctcaaccagtaagtatataatgcagatgttctaaaatcggaaaaagtcagagaccttgaaagcacttctggtcccaagcattttggataagggacactccacctgtaccttacagtggaggcttgttagatgcttgtaaatgccagcccctgcctcaagtaacaattgattctttttgtgtgctctcccaggtctaccctgaactgcagatcaccaatgtggtagaagccaaccaaccagtgaccatccagaactggtgcaagcggggccgcaagcagtgcaagacccatccccactttgtgattccctaccgctgcttaggtgagccggccggccgtggggctggtgttgattgggggcctggtcttgagggaagaaaaagaggatgctcctgttaggtcacatacacagacttgttcttcagcacattgccactctgtgttgtactgtgttttggactcttgcagttacattctgtgcactgaccctataggagcagtatttttgagttccctgcctcagaatgaatttacccagggtgtatattgaaattacaaattcctgggccagttccaggactcctgaatgaaaaatgcctatagtagcggatccgggaattcttattttaccgtatcgcatagatgattctcatgaacaggggccttgtgtgtttcttcacatagactttctagaagaaagaatctaatgtgaagctgcagcattttgttaatttctaaaaaaaaaaaaaaaaaaaaaaaaaaggctgttctacaataactactcctcttatttggtgatagtagaggaattggaattgggaaggctttttttctgcttacatcaaactggaggaaacagtctgattactaatgtttaatgtttgttttgtcacaaacctcaaatttacctcaacattttatttaaaaaaattgagtagttttatgtggtatcgtgctcttttcctctggaaactgtcatactccatatttaatctaacttggttattagtctgttcctagttgttgtttttatgtgaccagtcattgcagaagtcaagttctttgctctggtatcttacatctagatgttttccacaagtgtattcatcagtaggcaggttgtaaataaggatatagagattgtctgtggagattgtggacaaatattgatgtatattctgatgacttcttataaaggttaaaaggaatatttcaaagaaaatccaacagcaaacttacaaagtaaggatatttactgaagattccggagatctatgtaatatatggtcaaaaatgaatgtcctaagagcatactgattgctgttcattcatgtgcataatttgagacataaaatgaaaacactgggcattagaaagaagatttcacctggtgaatttacttacaatgtaattgatgaagagagtgtagaaaactagatttcttaaacatctgataattcaagagtttcctttttcctccttattccttgttcctatatgctttataaggcctcaactcttttctggttcatcaaaaagtgcagtttaattagatgaaaataagcagcacttaaattctagatacagaactcctactcaaaaaaatatagaagtcatctgtccccaggaactgtgtattttatactcacttagttattacaccaagaaataacacacagagattgaacaattcagtacaagttaggaagtagatcatgagtctgttaatttgatgggccaggctttgttaatgatttgtttcttttggttcttacttacctgttctatgaagtattccaaatatattttcattagaatgtaagctcactgagaacaggtagggctttggatgggcattattgctcctggtatgacactcaaaactgcagtcatgtttcagaagtgaacttatcattttacatagatttttctgcttcatattctattcagaatgatttgtattaaagttgatggaaagatgaaatccacattaagattgttatttactacctagtgccagttgttgtagcaaatatcctttgaaccccaggtctattttatcctatctgttgatcacttcctttgcccctgctcttcaagcctcctcatctctgaaaagctctccttccactgggtgtggtggctcaagcctataatcccagcactgtaagaggccgaggtgggaagattgcttgagcccagcagttagagaccagcctgggcaacataatgagaccccgtctcttaaaaaaacaaaaacaaacaaaaaaacctccaagtgaacgaacagtacaacaagtaataaaggatataaaagatgttctcagatctcaatatcaagtcagaagattttataataatattataattacacggagactgtccaaatatttgtatttgttgtgctacactgcattatgcaccatttagggaaacaacagcctaagtaatgtggttttaaataattaatctcatctaccaaatacctgtttgatagtaaagttaatgacctgtcctcaccttatgtttttaaccattatggaaagagaaccacttgaaaatatatcattccactgacagataattacccagctgtgaagcacaggctggagactggcaaggagaaatggagagaagcctataaaataattctttctcagggaaggagtttattcctgccaaggctttgccatcaaccattatcagatttctctttcatcctccgaacagattctgggctcctttgatgtggaggtacataattcaaaaagttgggtcacttgtgacatgttaagcaaatttctcagttctggttgtgtctgatgtgaaatgagcacgttgacactaactgttcttgactactatgggactagataatcatttgctatttcctgtaggtacttggcgtgttgaatcattttaccatattttctcattttatgaatcactggtccttttccattggacctgaaattagaccctaatatgacaagtagagcatatgttgtctcttactttgttattaaccttagattagaattaaggaatataggtgctgcttttttcttaggtagtggcaaattttccaaaggtctcaagcccagagtataatacagagttgataaaataacctggtagagtatgtagagcatgccttgtctttcaggaaaaggaactgaaaaacataggttttccaataggtgtaacataggtaacatagggacataggtgtaactgatgtacattttacttgcacttaatagacaggcagtgttagttcttcgtctctcttcacaggctatacaactaccaagatccagagaggttgaatttcttgctataactcacagcaaataaatgggagagtcagcactacagtccaagctctcttgattattggtccagtgttttttacagtatacacaaaaatttgttttaaaacaaatattcactatgaattagagacaatagcactaaaaaagaaactcacagctatcgttgtgttgacagaggagacaaccatgacctagtataggataaatctccatgtgatatgttttctactttatagtagtagtaggtaacattcttacatattattcctgcttaacaaagaattactgttcagcattaacataagtatgctctaaaatctcttgactgtatccaaatatatgttttagacaagagttttttttttttactgacctagcaaacaaaataaaattatcttaaacattaagcgtgttaaaattcaaaacaaagcttgaagagagaaaaatgcttgttatgtgtggcatacaaccttcctaacctctttatcagatgaaggatccagtgtggcactggattatttttctgtaatattttgcctcggacatatgtgctatacatttcttgtctgcatggggaaagtatgtcaggttgctgttgccactttcttcccatggagtggataatttcccttgagaataagttggctttctcatctcaccctttgcttttggtagtacctctggaaccagagggtaagattcatcttaatcatgtgaacattttattaattatctcatgtgtgattcaagcacatcattactgttactcaaggagaatattttctttgcaaagctttcaaccctttccatttgaatgactgctcttcatggtgtaatagatccactgttgaaattggcacttttctgtacttgtctctgaccagcaaaggcaaggaacattgcgtaaaataaattactgttgaattattggggcaaagtcaggttaatagcttaatccaaaaaaggaattacaagtgaaagaattttaccttaaatgtcattctgtttcattttgtaattaagaccttccaaatgtgtaagtagtaatgaccagaaatcttatcagatatggtcaaatgagaaaggtattcaattcatattaattttgaattttattgttttaatacaattttaggaaaagcatgccttgttttctgggtttcttggctgcctttgtatcaattatctacagctatcttctttagcatggaaaggatgtatttgaatactgtgacattttataccagggtaattctttgaatttatgtaaacaacaactctcttgagacacatcagtacaacacaatagtcagaaatgtcacatgagagttcaccaaactttaaagatggcgatgaggatggaaaaacatttttattgtagactttaaggatcttgtaaatccccgtatgtaatccagtgtgctagagaattggtgcccatggcgcctcctctccccaccgacctgcactgtggaaatcctactaattttgaagtcatgggagatgcatgtgtgggacctatacatgcactgtgatgagaatgatgacttcatcattctcattatttaatgagcccagctgctgcatacaagaaggatgcaaattcttgaatgttcttgattgtttacatcatggtctcataaggaatgaccagaattgctgggcatttcttcatcaggaaaggctaatcagccatccttggagagacatcagactcctttatatgtggccttcccatgggacctttgaatggtcaacgttaatcatgcttcagaaccagcatactaagtaaaagaaaacatgtccggaaaagaaatcttatcagtgtttatctcccaacagtgggattacaggtgattttgattttatttaagcaattttctatgactttgtataataaatgagtagcttttataatcagcaaaagatagactatgaaatcagtacatataattttgtatttgtatgtagtaccattgaaggataatagaaaaaagtcaaaagacttgaaagtcgacacagaatgatcattaatttgttttatctcttggtagttgtactttatgagctttatacatacagtatgggaaaatacactttagttttgaaaacaccatgatgccaaaataaaagaaaataacgttcattcatacgatcttcaacaaaatttaagcagcattaatcatcactgattcttcaggaagattcttgatcttccttaattttttttccctccaaaattgcatatggcagccacatttgtttcaggccagaaggaagaatgggaagagcttacatttatctcacagattccttctgggtgaggaagacttagaaagtgaagccctcttccatttgattaagcaagaacacctataaaaatggtgtcttcggccgggcgcggtgctcacgcctgtaatcccagaacttcgggaggccgagatgggcggatcgcaaggtcaggagattgagactgtcttggctaacaacggtgaaaccccgtctctactaaaaatacaaaaaaattagccaggcgtggtgcgggcgcctgtaatcccagctactcgggaggctgaggcaggagaatggcgtgaacccgggaggcggagcttgccgtgagccgagatcgcgccactgcgctccagcctgggggacagagcgagactcagtctcaaaaaaaaaaaaaaaaaaaaaaaaaaaaatggagcccttctaggtaggtcatcctccatggctcactgcagcacttccttggccctgtcccaagttccataattgcctcaattgcattggctcctgcttgatttgctttctaaaactcaggacagaggatgagttgaggagactgacttttttaacaatcgcattttgaaaagaaggaagcgtagtggtgtttcttggctccgtttccagttttgtttcttttcattttaattattgtacctggtattgtgtcctctttctgggacttttaacaactaatgttttgattgataagagctctaatagcatgggtgatttatacttcattacatcttcagttttgtcttctttactggagttgtattcaggtgtcattaagtaacgaggcattaaaaagaaacgataacttttgaaaaactgctgttatggcttatgagtgggctttgctgatattttcttgaagcacagaatttatctatctctgtaggtcctagatgataggtgagaaaaagaaacccagcttatttggcatgatattgtcccaaggcttgttagtaattgctttgaaaaatgaatagcaaggctaatggacatctgatttgtagtacatgctaagaattgcaaatgtgtgctcaaaagaaatttctctgattacaaaagtaacatatattcaacgtacaaagttgagaaaatacaaccactagctaaaaataatcaaaaccatttggcttccttgcagtctacatttttttcatgtatgttttgcttttgtttttagtgttatttaatcgtttcctgttttgtgacttgctttttacacctaacatttttagaatactctacctgtgaaattaaatattcttggagagcataatttttaatgtagcatcacaccagacactgtaatgtgtttactcttttttatggtcatttaggtggttttctttattttgtggtggtgtaatagttgttataaatgatgctgtgataaacatcctggtagataaatttgtgtttagttgatttttatataacagttattggcggaatgccttgcaaatcttatagttggtgtaataaaatatatgcgccacataattgtttatgaaaatatggaggaaaattttaatactgatttatgatcctgagtttaacataagcatggatacccctacatttagctatgatttttttattgatagagtaaaagcgcctgtaatttctacttaaggccatttaaaataattactatttaaatctatttaaacaattttaaatattgcttttccaaatttccaccttaggaagtagttaattgaatattctcagagaaataagtcctacaaaattgaccaataaaaggtcagttacgtattcattgtgtacgttttattgatcacccacagtgtgtgagcccctggaggtgggtgaaatgtgggcctccctcttacagagttgatagtgggcctgaaggggatgggatttcagctcaggaatttaaggaagacttgacaggaagtagcattgtgagccaagatttcaaggataagatttcaaggcaagaaaggagatgtattttaggtattcagacagagggtcaacaaagtctttaaggtaggaactagttcacttttcaaaaagaagaggtaattggtcatgataagagtagtagtttttaaaaatcattactgttttcattcatttataatgaatactattattttataattttaaagtttatatccaaataattgttttcaagatggtaatgaatgtatattgcttttatgtatacacatagtactttttgctttttggtaactaagtttataatttttgagggcaggaaatatttttgtttttcacttacaaagaaactatattttaataagagttttttgacagcagtgctttatgccaaaggaaaataaagcaacatttaacatatcaaagaaagccaatgcaaaacaaggattatttatttatttatttattttattcatttttgagatggagtttcactcttgttgccccggctggagtgcaatggcgtgatctcggctcactgcaacctccacttcctgggatcaagcgattctcctgcctcggcctcctgagtagctgggattactggcacccgccaccacgcccagctaattttttgtctttttagtagagatggggtttcatcatgttggccaggttggtctcaaactcctgacctcaggtgatccacccatcttggcctcccaaagtcctgggattacagacatgagccatcatgcccagccaaaacaaggattttatattcaatcaaactgacattcagatatgatcacatgaaataaatatcaacgtacaataactcagggcatattttcacattattttcctgtagaatctgctagagaacaagtttcagatacccaaaatacctagagaaaaactgatataaggatgggtaatgagcattaaggagaaacataaaaactaagactcaacgatggtaaaaagtatgataatatagtattccacagctacatgctgtgacaataaagagattctgtaactgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccaggtgaaataaacagccttgttgtgacagtaactttaatggggaagaatgagaagaagatgtgggtaaagaaacaactgtttttctattaatggtggtagtattagtgtgtaattctgagcctggtgcataagtaatatggtgtaacataagtgaatagttgtgtgatattttaattcaatcatcccatgtatttgagaatcagaattttgatgtggtaaaagaagattcacatgtaacatataatctattaaaaagataccctgtagtcatgagtttgacttttaggtatcatttctcagtataacatattgttgtagatttcagataacattttttccccataaatactgtccgctgcaggcctaaaaataatgaaaaggcctaaaagaccaactcagtagcggtaaacaccagtactgcacctagattatggtctttaggaaccattttccagtaaaagataccagtaatctttggaaagcaggatttttttttctttttttttttttttgagatagagtctagcttcgtcgcccaggctggagtgcagtggtgcgatcttggctcactgcaacctctgcctcctgagttcaagccattctctgcctcagcctaccgagtagctgggattacaggtgcctgccaccactactggctaatttttttttgtatttttagtagagacggaatttgaccaccttggccagtctggtcttgaactcctgacctcgtgatccacccgcctcagcctcccaaagtactgagattacaggcatgagccaccacaacccggcggaaagcaggaaattttttaaaagctattttaattcagtcatgtaaaaaaaatgagcagaaagaaacaaaaaacttaaaaaaaaacttaaaaaatgagcagaatcttaggaatcacctgcgactttggttattcatgcttagccatttctataggaaattccagcactatttgagttagaccactaattatatgtgtgttgtagctttctccaagagataatggaattcacaaatcaaaactttgagattattaagtgttacaagtgaattataaccccagtcatttgctttcaaatgaacagctaaacatattttgtgttaatttcttatggatgctgctttgtttgtttgtttgtttattgagacggaatttcactcctgtcacctaggctgaagtgcaatggtgagatctcggctcactgcaacctctgcctcccgggttcaagtgattctcctgcctcagcctcccgagtagctgggattacaggcgtgcaccaccacacctagcagatttttgtatttttaatagagacagggtttcaccatgttggccaggctggtttcgaacttctgacctcaggtgatccacccaccttggtctcccaaaatgctgggattacaggcgtgagccaccattcccggcctagataggcttttagttggtttccatatacagtgtatatagggagaaacagactaagacagacactggcatccacagaagtaaaaataaaaagtaaggtataatttaaatttcacacggtcatggtcacatttttcagctttttgcacctatgttgtataaaaaagacaaaaatgcctttagaggctcaagttttcaggacttcctgaagctgtgtcatagtttaaaaatgccataaaaatgccgtcagatttaataacgtatcagctgaacactggatttctgttatgttgagtcttcaaaaatttctccctgtatgaggaattaatactgttatgtctgatctggtggtctgaaatgtgaacttttctgggccaaccagtaaacagctgctgttgctttatagctgcgtaattcagtcttggaaattattagataattcccacaccatttcagcttgctgttttaccataaatttaatgtgaacagtatttctagctaacctcaagctgtgtttattgtcgtggaattttctcttttattctgaggtaaatgattacaaatggttatgatgaggaatcaaagaagaaagtggactttcttcaaagttctttttctactctagccgcttctgagcatctttctcaagcactgtgtttccatcagtccctaccccaagcagagaaaggaaacagttttcccctttgtcttcagaaccctcttctcatcgtgtcattttccaaagcaaataaaaatcttgagatattgtcttgagtttgattttttttttttttttttgagatggagtttcactctttgttgcccaggctggagtgcaatggcacaatctcagctcaccccaacctccgcctcctgggttcaagtgattctcctgcctaagcctgccaagtagctgggattacaggcatgtgccaccatgcccagctatttttctgtttttagtagagacggggtttctccgtgttggtcaggctggtctcgagctcccgacctcaggtgatccgcgcctcggcctcccaaagtgctgggattacaggcgtgagccaccacaccctgccgagtttgatgttttttttaaccattcaagccagtaaataactttccagacagctgtagtagaaaacagaatttgtgtgtgacaaaacttaagattttgggattgagagctctatggtttatgccatgtggataattgtagccagatgaagaatatgaaatttaaggaagtgtttagagtggtacagacagctattattacgattcttggggtagaagagtagcttacatacaacataaaataatggcattaactgaattaacttcagcctttgccatgaaacccaagctttcattatgttttaaataatgaactacattaaaaatagtatataaatatgtaaaatatattagacatagacttctcataataaattatgggaacttttgatgtatttcttccctaggaaaagaactaaacaagtgcttctttgtggacttaaaatttttcagtttactattgtgaattaggtacagcatatctttataattccagataatacccataaaagcagaactgtttatttacttattatgaagggaatactgaaatgaaattaaggacaatttttttctcacgtattatatttttaaaaagttatttgatgtttgtgattaaataaagaatgaatttttaaagccagttctcaattagcactgaggaaaagaatatgctttttttcaggtacacaaataagcatcatggatataagaaacgacataaagatgaatctacagtctggattaagacgtattttaatttcagtgtcaaaggctgttaggaaatattcagattttagtacttgacaaagaaggttctcaatatttgtttcagtgttcagtgaaaggataaattctgtcgtctttctcttttatcatattagtcactgagtggtttcattaaacattccctcttccatatcccctgataaatttcaacttgttggtgatgcatcccaggagtgtctgtctttttttttttttttttttccttctcctgtcagtgagtcttaggctttggctttgaaaccctatagtgaagggaaatctcaggcaacagctgtgcaaccgtctggagagcagctagtccagattggaggagacgaacgaggctggtcgcaggagagaggcctccaggaaaaaatggcattgatgcattacctgcgttaaagattttcctgtacttagcatgcttcttagggttctactggagcgtttgggaaagatacagtattgatggatgcatagaaaatgaggcaaattttttaaatggggcaaatattaactgtagacaaagaaaagccaaaagtacaaaataacagcgttgtaagatacgaagataaaaatacgcctaagtatgagcgttctggcagactcacaatacagatgccatatatggggtaaaaccataccagtaggatggtgggaagggaaaggggtgggctcatgttccatagtgggaagacctacagcggaaaaatcaggagaatagttatttaagcacagagtttagggagtaagttgcagaagagacaactaaatgagatggccgtgaatgatttttatgacctcctcttgttatggagaaatcgatcaaggaggcctatatttgatggcaggaagaagttgagtttaaggtttccagacatttgttttaatctggaaaatttctttttttctttctttcttttttttttttttttgagacagagtctcactctgtcgcccaggctggagcgcagtggcgcagtcttggctcatcgcagcctccgcctcctgggttcacgccattctcctgtctcagcctcttgagtagctgggactacaggcgcccacaaccacgcccggctaattttttgtatttttagtggagactgggtttcatcgtgttagccaggatggtctccatctcctgatctcgtgatccgcccacctcggcctcccaaagtgccgggattacaggcgtgagccactgcgcccagcctaaaatttcttttaagcttagaagttgcaagtcaagttactgttaaaggcgtcctaactttgaattagataaagctaaactgtggtttaattgagctgagtttgttgtatgctatatctcaacttcacaagatgtttgctttttcttggctataacctaagattatacaaatataaaattacctttatgcccatttgatagactttagggctgaatttccctgtgtaagatgttgtagaggtttgtacttgtgattgtttttactctagaagcatgtttatcttcactcctttagtgacacgtgtttgttcaggaacttcaaactcaatgtgatcaaaactagactcatgttccctgaatagtctctcctgactacaaatctgttggaaacttccaatcctaattaataattgtaaactttttaatgtaagtcatatgaggggttgttgtgagcataggaggtagggagatggtagtgtgagctggagcatatggtaaaagttgtttgaaagaaagtagacccatgatgtggatcctgagggatacgtaaagaaaatgaagaggtgtagatttaaaaatgtttatggggcctgggcgtggtagctcacacctgtaatcccagcactttgggaggccgaggtgggcagatcacctgaggttaggagttggagaccagcctggccaacatagtgaaaccccgtctctactaaaagtacaaaaattagccaggcatggtgatgggcgcctgtaatcccagctactcaggaggctgaggcaggagaatcacttgaaaccgggaagcggagattgcagtgagccgagatcgcgccactgcacgccagcctggatgacaagagcgaaactccgtctcaaaaaaaattaaacaataaataaataaatatattcatggggatgttccagggaaagtagtttgtgttggtagccttgagaaataataatagaaaattagaatagaactaagttggttcattaaagttggaacacttgtagagatttttgatttggacagacattaattcatttgattatttctcttattcgatgtccagaaaaatatctgtacattcaatgtggttttatttgtactgcacatgtcattaataggctaaagttacctctaagatacctgctttcttagtccttgttacgctgtaaattctgggcatcaggatatagctttttattatgttagctcttttaatagatgatacaattggattggggaaaaaactgattatactctggagtaatactttcatagcctgtagtatcctgcaaatagctcctggtcatcttcgaattttactagcaaacttgtagggtaataggttgggacaaagtattataatcagtggctttgagggcctgataagaggaaacaataattgtgcagctatattgtgaataagtagtgcatgatgctgatggttaaccctttcctgcggtgctcaaacattgggaaataattgctttttgttcaaaatgtaagctcttcgataattgagacttttgtcaattcactgaaatattcccagagcttgaacatgtctggtacatagtacatatttaataaatatatagatttaatgaatgaattgaggatgtagccaaatattggaaaaggaaagggaaaagaaagaatagcccaaacattagaaagacagaagatgtggagcagcaatttcacatgcctaaaagaatttctgagattatggcaaaatcatttactttacttactccttattgatcaacaaaggaagagcaggttttatgtaacaaccaagaagtaacatagggatctcagaagagaagaaaccaagtgtctttggatcttaataaaaagaacattcaactccagaaatagggttaaacctatcctacacatgtctagtaaaaagtcagtgtatcagaggcatctgtgtttagagataaaacataccattagattcatttataatagtttcattgtccttagtttttaaggctaatgataaagatttttttttttttgtgagacacagtctctctgtcacccaggctggagtgcagtgacgcaatctctgctcactgcaacctccgcctcccgggttcaagcgattctcttgcctcagccacccaagtagctaggactacaggcacacgccatcatgcctggctaatttttgtatttttagtagagagggggtttcaccatgttgcccacgatggtctcgatctcctgacctcaacagatctgcccgcctcggcctagtgctggaattacaggcgtgagccaccacgcctggccttaagaattaattttcacagaaatctgcttctaaatattattcagtgataatagattttagaaatttcagattcttatgttgtaccttaaaggttaggatactatttataaatgctaaacatgaactcctgtcatcctattttaatgtctttattaagtgattacatgaatgtggcgtttcagtaggtgtttggtgtattaatagatgtaggtactcccctcttaaacctttaagtattttcatgccatgaaaaatttggggggcattctctttatttattgattaggtacctgtattttcaagaatattactcagcttcagttcccccaaatcttttttagtgttaactaccttccgagaacgtggtataacattttaaaatatattttttgaaggtttggatgtcactgaagatccccctatttattggatggtatctttatcagctgggaagataattagtttcccaatgttgctatatttttatgaataggtcctgtagctcttgctttcttgaaagcttagaattgattgtaagccatggactaatgatattctccaagcatatttaacatgaataggctcatgttcagtatgtcaagaagttaccctgttgtactatttaaataatttgagcttagttttctttttccacctttgttctaaattcttaggtgagtctgaattcctgggcatctgtgcacacagcttcttcagtaggtcctttactctcattgtatctgatctttgacttcataaagacccttggcctactgaccctgtatttaatttcacatctcaatagtatttagccttctcatatttttcctcttctttagagctccctgatccctcactccagtcattcaactctgtgtattcctttaacttccaccctcgctctgtctcttcacagatatgcttctttatatggtagtcagaagttcctgtgtgatcttcgtaacctccagttccctccacagtcacctgttatcaggcatctgttccttgagctccagggaatgagctctttgctatcattctggttgtcggactcactgggcactgttgtgtcctccacagtctctcagtggcatcggttgatgggtgcattctccccacactgatgtcattctgctgcttctgattttctttctgctgtcctccattttcctttcaggctcccttccccgtcctccccgcgccaccttttgcaatatttaggattcagaaattccaaatattgcaaaatatttagaatcagaattcagaaattctaaatatcagtgtttaataggagtaccctggggttgtccattttctcacacaacacatacttgctaggagatctcataagtgcagtggtttttcagaggcctgcattgatgattcctgagtcattatgtccaggccaggcctcatacatactatttactggttctctttctgcgggtgctccaccaagaattcagactcaatggaatatttcttctaagatgtacaccagttccttatcaaaaaatggcaaattcagacttcttaggttaaacagagaactcgtgaacatggcatatgtctgttattccatttttctctgttggcttattgctgagtaccatttgggataaaaatctgtttcaggcaaaggataggattgttttcagcttttattaaattctcctagacccttgattttatgcagagaactaattaaatttgaatgaatttaatgtagaaaccctgctattgatgcagaaatcaacctgattctggactagcaccagaatcaactatttttgttgtttttgctttctttttttttgcttttgctttctctgccggtaaataacaactagtatgtaagaatcaaatgaatcaagcataaatccctaggaaatatttatgcattcatttttaacaatttaaagatgtgaagatatataattaagcataatcctctcaaagtttgacgttgaaaagtatttcagatacttcaacttaaatatattttttgcaaaatatcttttttaaaaaaacagatgtggtctcagcaatgtaattattacagtgtgaggagagcttacagttgtaccaaaatttataactaggaagaagagaatgtgaaataatccggaaacctacaaaactgtcctatacaggaataccaattaaacagctactaaaaatgagtgtaaaatgacaatatggctttatcaagtgcttagggtctggaaaaatgcacatattgcctgttatttattgttatacttaatgaatgttcttttgcacgtgagaactgttataaaagatgtcttttgtacatacttggtacaccagttggctttttaacccattagctgttttcccccaaaggtggcctactctagatgacgttaaaaatacacattttccagggacttatataaatagtcaactgccctattatggaaacttaaaagcgaaggccctgaaatatccagacagtttgaacataaaccaaaaatgaagtgaatctctagaattgctgtgtaatagcgtgagtggggagggggtccctcaagagagggaactgacctttttcttcctcgtgggtgaccttgagtacacactttatttagtcattaaaagggtcacctgaagcttagagaatgaagatcctacagcctgttaattttatcattgttagaaactctctgcctttggcctgaaaatggtaaatcacctttcttagaagattctcatatccagatattcttaccaaatcagaatcttttccagcattttcttcaaaaaaccacagttctgggttaaaacacagcagatcctaactgtaattttcctttcatgtacattttagtcatctttataattttaaatgaaagacaggaactacattatttgaaataagggttaaccccctctaattataagcattaatcacacacagttttctcatttctaaatgttaaatataaaatgggagctatctcttcagacacttttctgttgccttctgtgtgcggcaggaccttacttttaagcttagtttgatttaaaggctgagtttctgcttgcttggaatgcttgctcttcaaaatatttgctccctggagagggaaactgaagatggagctttcacgtgactttggattgctgacctggaagacgtttggggtaataggatgggctagggcatggttccactgctttctgtttgagtggggtcaggaaaggaaggcggggctcgctgtgtgcaaacaggaaaacatagtctgaagatgtttgaagcctgagtgcactttcatttgatgccttgctttattgcttaagagaattttaaactgccgaatccgcaaatgtgctgcagcctataatgacacatatttaaatgatttttgcatctaaacaaatgcattcactctttgcctggtgtgtacaatttgaatgacactcgtgctctgcctggaaggaacagacgtttttcattataaaattcagtcaagcagaaaagtagcaaaggaagcagaaatttccatttacatctatgattgaagttgtagtgataaaagaggatgactaagttgaagagtagccttgttctcattctgctatctgacatgggatcttgtcactttggtaatagtttttaaacttacattattgaggaaggctctgatcagaagtctcaaattatacatgttcttcaaccttagatttttctgggtgttttgtttcaaaagtctcaaattatatatgttcttcaaccttagatttttctgggtgttttgtttggttttttggttatctatagatagatttgagtatctctttttttcttaaaatccgttacttactagtaataaagacttaagtggtagctttacgctccattatcacagagattcacagtactttttagtttttacttgtgagcctcagcaggtgtagacagataccttagttgccactgataacatccagttgccactagatcaagaaatggttcaaaattctccaggggcattttctgctaaagaagagttggtgatcttccttttggaagccttaatgtacttaaaccttcttccttagaagtccagaaattcaattatttcagctctctgtggagtgataagtcctgccaaattgatttacaataatgaaactaagccttgtttacaaatctaagtggtgatttctaagtccacagaggcgtggtaacagagagagagattctgatttatctgggggtctatccgtgtttgaacagattgtgtgatttttgaaacatgattcaaaagggatgttgataaattctaaaatacatttttattgaagagcttgatgaatcatgtatacttactttatttgttattctattagatattgtcttcctcatccctaggtggtgttgctagtacagtgacagaattcaaatccttctttttcctctgctctaacagagctttgtgaactcatagcaatattgtaatgcctggtaaaaggtggtgccagtttcaagtactatatcctaattacttcatggctaactcttgttattgttaacaatattgttaactcttttgttaaatgcagtgacatcttttttctttctcattctctgtgtactttttgccctaaatagttctgcatcttttaagatacaagtttgctttttcttggaggtttttatttggaaaatgcctgaaatatatagaccaacatttgttcctccaatggttaaattacattgtctcccaaagtgaggcattttaagtctggactatacccaggagaatctaaaagaggcagttaataagctcttgaagagcacagtggggtggttgtgtatttattgagtctcacacttaggagagaaataggctggaccaaatgagcctgggcatcaaaagcatgtgggtggtcgttggtgatatgtgcagtgatgagtgtgtgtgctgagggtcctagaccaggctggcagggaaatgaactgaaggcagtgaagcctcccctgataactgcagagagtgctgcagcatccaggacctcaggatcatgatgaacaagctgtagtggatggaagggagaggaactatgggaaggatgagtttctggccagaaagtggtttactggagtgctgtgtctgagtattacatgatctgaggaccatgaggtccagctttgggagtatggagagtttgagtggagtagagttatagtcccatggtcttctgattcacagacattcatgagcgataagtatctattgagaaagtggaagcatgatttttatgacctcctcttgttgtggggaaatcgatcaacggggcctatattggttgggttctacaaccaaatagaatgtgttcagcaggagtcatgttttgggctcctcacaatgttcagtgttagttctgttcctttctcttgcttccacataggaaagactttgacccaatgaggaattagtcattgtcctttgggtacacttccggaatttgataatcagttgggcacttgattctagtacatttgctaaaagtaattaataccctgcaattggaagcatgcagcaagcgactgggaatgctaagtgaaaggtcagaattgaaagagtggaggaggctgttgacccttaggcatggatgatatgtctgagtgagaaagcaagaagagtagaagacagagccttactttataatcagaattatgaaaagaggagccaatgagagggaaagaatgattggcttgagatagattggtggaaactggagaagattgaatttaaagaagaaaagtgggccaagttcagtggcccatgcctagaatcccagcaaattgggaggctgaagctaggagagttgcttgaggccaggagtttgagatcagcttgggcaacgtggcgagacccctgtctctacaaaaaataattaaaaaaaaaattagccaggcatgttggcatgtgccggtagtcccggctacttggaaggctgagacaggaaggttgtctgagcccaggaggctgcagtgagctatgatcacagcactgcactccagcctggttgacagagggtatccccgtctctttaaaaaaaaaaaaaaaaagagaatgtggcagagtagtcagagaactggagggctgagaagagactgatggcatttgttgttcttgaccttgaaagaagagttgcagattgttggagcaaggccagatggtaataggttggaaagaacaagtgaggggcgtgagagtgacagtctacaaccccgttaagaagttatctgtgaaaatgcctcttcctgtcttgattatagcctccctcgcacatggctttctgagtatggtatgtgaaaacagcatgctgtatatttttaccttcccatatgagttaaggttttggtaatgacttgtggttcttttgcctcacggaacaccaacctggttggtattttgtcggcaattatgtggtttttaaaaagccccgtatataaccttaattaattgcgtctctaaaatctatcaggctttgagttttttgttttttttttttaaataaggcagaaagaaaggaaagtgttaggagaaagcaaccagtgagaatacctatattttgaagaaacaaagtagggaatttagaattatctctactatatctgctttttcagctcatctctcgggatacagaggactgaactaagctaaagtaggttcaagtctaaaggaaaccttaaattaatttctgtattagaattaatcacacacctataaatacaatttatgatatgagaactgcaacaagagaaatggggggagatgagcagtttgctgatcaatagggttaatgatggtaacatagaatcctagtgatatgcctcccattgactaaaatgtatgcgttaagatagcatagcgcataaaatggtgtactgcagtctcagtgtattcaagcttattatggtttctctgcctaggtttgtgtctttggctttagattttctcccataaccccaacctgtccacattcaagtcactactccttgaaatatattattgatctctaaaatctgatgctaagtctgtcttgcccaacggtggccactagccacccatggccattgaatatttgaaacctggctagtccaaactatgctgtgagtataaaaaacccaccagatattaaaaagttagtctgggagaaaaaaacaaatgtagaatgtcttaatgataattatttacattgattgcatgttgaaatgatgaaatttaggatgtactgggttaaaatatattaataaaattaattttacctgtttctttttacctttttatgttaatgtggctacaggaaattttaaattagatatgtggcctctattatatttctgtgagacaaagctgctccaagctgttttggtccagaactatatctcggttcttttgtatcctacatggacctgcatagaatggtatttagtaatactcagcagtagcagagatgatctcttatcaaattatgttaagttttaatttttattcttgtctctcaccctatgtgcacctctctggccaggaggcatttatcatatcaccttttaatatttggaaatcacttgatctgcttgagtcattgtgttgttttcaaatctagaactctttctaccttattttgtaacttctataattaaacaaaaggcgaaccaggagcagcttggctcttagggatgtgtgaaaaggcgctcagtccttaagttggtgccaaaagtgacaaatctataggatgagatgcaggtttatggaagagaagcatgaaaatttttattttttaaaaggacacagcaagctagtcaccaaaagacagatacttgattctacttatatgcggtacctttttgaatttgaagagtcaaattcaaaaagatggaaaacagaatggtggtttccaggttctggaggtgggggaatggggagtggaggtgggggaatggggagtggaggtgggggaatggggagttgtttaatggtgtgcagggttttagtttagcaagatgaaaacagttctggagatggaaggtagtgatggttgtacaacgatatgaatctacttaacactaaactgtataattaaaagtgggtaagcaaagagtgtcttacaaagcaataacttgtaacttaaaatttttaaaaaccttaatgagattagttgtaatgggttatcttaagtagacccttactgccggaaggaacagctgaatcacatcacttgggagcttgttagaaaagcagactcagtcccaccctagacttgtccaatcaaaacctgcattttaacaaggcccccaggtgattcataggcactgtaaagcttgagaagccctgctccaaatatcatttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccaggtgattttgaagcatggtttgagtttgaaaacccctaatctggaaagctttaacaactattactcttacaattccatcttttaacgaatgttggaattattaaatacttgtaacaagaagtcctgttattgataaaatcaagatatgactaatagtgcagtcaaaaagaggcaacaaaaaagcacctataacttatcttgggttggttaatgaggaagctgtcattcaaaattagtaagactactgtaacatttcttggggtcctgaacattggaatgagagtcggttttcagagttgagcccacctctgtcattagctttgtgcaaacctcatcaggctcaagattcctcatttgtaaaggggaatgaattctctgaccagttagtttacattcctaagacaaggttaaatttggaaagcaaagaattttcggtatatatgtgataattttgaaattcttgaatttttaaaaaatttaaatgccacattacttatatttttttctaaaaaaaagtcaaaccaagcgctgtctagttattaatagataccacagatgagatgcctgagttggtaagctctttttaattctagttcttttcaactacaataattttatagacttttttttgaaggctagaatgttgatgtggaatcaaataggtatgcctctatgtatggtagatgcacctgacagggatcacttgacttgaacatgccctgacaatgatcctgtgtggcaggtgcacctgattctgagttctgagttaagaaatccgggagtgggccgggcggggtggccggtgcctgtaatcccagcactttgggaggccgaggcaggtggatcatttgaggtcggaagtccaagaccagcctggccaatgtggcaaaaccccgtctctactaaaaatacaaaaaccagctgggcgtggtggcgcaggcctgtagtcccagctactttggaggctgaggcaggagaattgcttgaacccgggaggtggaggttgcagtgagccaagatcacgccagtgcactccagcctgggcgacagaatgagactctgtttcaaacaacagcaacaacaaaacccaaaacaaaaaaacaacaacaaagaaatccaggagtggctaacccagagagccattccttatctgtaaggaacatctgagccctcatctccttctgtggaacatgggcctcgccggggattgagaccctttgttatgagttaagtggaagttgccaggtggagattgttagggggagggtgttaaatgagaatgctgtagagaccacatgccttttgcaagcggctgcggttcctctgtccaacccaccaccactggactctctaccctgtatgcaagcccccagtaaaaccctatgagacatacggttcactagctctgggcctcttctggctcttgaacctggtgccatccacattgcagtcagtaggagtttggcatgacaccttattatgtgaacttttatatcaagccattaaatttttttaaaatagactttatattttacaacagttttaaatttacaggaaaattgagaggatagtccagagagttcccataggctttgcatccagttttccctattgttaacatcttatattaatatggtacatttgttgcagtcagtaaaccaattttgatacatggttattaactaaagtctatactttattcagatgtccttagtttttgtctaatgtcctttctgtgttccaggatgccatccaggaaggcgcattatatttaattgtcaggtctccatagcctcctttcctcttggctatgacagtttctttatacttctctagttttttaataaccttaaaggttttgtattggtcagataatttgtaggattcccctctgtgggaattttctcatgctttgcctggggttattggttttaagaaggaagaccacagaggtaaaatgcccatttcatcacatcatatcaagggtacgtgtttatcaacatgatacagccctgttggcattgaccttgatcacctggctcaggtggtggttgttgagtttctccacttgaaaattactcttcttcccactttatgtgctctactctttggaaggaagtcagtttgcacagcccacaattaaggagcagagaattatgcttcattttcttgagggcagagtatctacataaattatttggaattcttctgcgcaggagatttgtctcttttttcctatttatgtattcattcattcagtcatttagactcatggatatttacattgtactttgatttctaatccagcactacttcataatttttattgctcaaattattccggctttagctattagaagccctttcacttggttcctatgctcatttgacatagcctcttttttttttttcttacaagatgctgcagtctcatcttgcatattttcagccctaatcctagaatcagctgttcctccaaggagcccttgttccttttattggagagtaatgttattggagaatagtattaaaatctggatgttaaggatgctcgttgccactggagtttctttgcttttaagacttctcagttgatagagcaaggcaatgtatttgtccatgttcacccttatgttatgcagatctataaatatttctatagctaactagttgtatttatattaagctataatatctagtctatattaagctaaatacaagttcatccggatgtttcctactctaacgtattaccacatggacactatatctctcctccttggttatgtataaattctcactccatccaccatctatgtacttaattgttcagtttcagtatatgtgcgtagccgtatcagaattgttaacccaggctgggtacagtggctcatgcctgtaatcccaatactttgggaggctgaggcaggtggattgcttgagcccaggaatttgagaccagcctgggcaacatggcataaccccatgtctactaaaaatacaaaaaaattgctggtcatggtagcatgtgcctgtagtcccagctacccgagaagctgaggtgggaggatcacctgagcccaggaagtcaaggctgcagtgagctgtgatcgtgccattgcactccagcctgggagacagagtaagactctttcttaaaaaaataaaaaataaaaaatataaaaaaatttgttaacccacacctatatggatctttttaaaagctgcaagactgctaacaaatatttatttatttatttatttatttatttatttgagacagagtctccctctgtcacccaggctggagtgcaatgacacaatctcagcccactgcaacctctgcttccccggctcaggcgattctcctgccccagcctcccgagtagctaagattacaggcacccgccaccatgcccagctaattttgtatttttagtagagacggggtttcaccatgttagccaggctggtctcgaactcctgacctcaggtgatccacttgcctcggcctcccaaattgctgggattataggtgtgagccaccatgcctggccataaatacttattttgttcccgtggttttttttttcttttctcttttttaaagtaaatcctttgcactatttttattattttaagaccagtgttattcagagcctgggttaaacactattctgtgtgtgtgtgtgtgtgtgtgtgtgtgtttgtttgtttgtttgttttttgagacagagtctcgctctgtcacccatgctggagtgcagtggtgtgatcttggctcactgcaacctccgcctccctggttcgggagattcttcggcctcagcctcccgagtagctgggactataggtgcgcgccaacatgctcagctaatttttgtatttttagtagagacggagtgtcaccatattggccaggctggtttcaaactcctgaccttgtgatccacctcggcctcccaaagtgctgggattacaggcatgagccaccactcccggccagcactattctgtcttatactcactctgccatctgtgtgtgtatatggtacgtatgtgaggctggatctgtgcacttggaaaagttggagagatgatttaggtaaaacttttagttttcacttcttttgcctttttgcttatcttgatccatttagttcctaccatctggcaaatagttctcatctgaagaatcccatctgtcagttctcactattatccggtaatagttacagtgaaatgctggtgacggcaacagccactttttaaaaggatgtgtaattcaccctcatgtcctctttgagaacccagtaactgcccacactctgaagctaaaaccataacagttttatcacatggaaagtttgttgagaaatgtttggctgtttctgtgaagtaatcgtcccgtctcttgagtacagatgcctcccaggaaaattttcccagcctatttgttaatgtgaaagttacaaaagatagcatataatgagcacattcaagacaaaaaaatttgtggagtaagagtctgaaatggtaaaataaaaaatcacttaagaaaacatttatctgtagctgtcattttcatatacacatatctagtgtatacaagttagtaagtacataattctcaaaagttctacctgtctacacatctacacagaaaaattaggaaagtcttgtccagacttttccatcatcttcagtataaagcatcttctagctgttggaatagaaacaagctagattcttgactcctttctatttgattatttagatctgaccttcagacgacatccagaatctgagaacacgcaccacctctactgctctcatcctggtccaagtcattgtcatctcccacctggattaatgccagagcccccttcctggtcttctcacttctagtcttgaccccctagggcaagaataattagcttagaaaaccaccccagagccttccagcattactctgagtactggccagagttggacaatgtttaaggccccgtgcagtcagctgtccctgtcctgtcctggctgtcactcactcgcttgcccactgatctcttccacatcattcctccacgacagcactgatctccttgttcttctgtgagttcaccaggcatgcatctgcctcaagactttgtgtaatacttgttgcttcctctggctagaatattcttccctttgattctgaatactttgttccctcacttcctcaagtcttcactgaaatgtcatattttcaagtaggcattccctgaccaccctatttaaaatttcacccctcagaaaaaacaaacaaaccacccctttctctgctttatctatgtaacatttattaccatccaacagacactgtatttttatctgtattttttatcgcttccccgctaggatcatatatcgttttatctgttttgttcactgctgtattcttagcactgagacataattgtaagtatgcagtgaagagttagtggataaaggacagtggctgcaagaggggatttaggaaacaccccctcccagccaggaccagcactcggtgcaagagttgaaagagttgatcactcagattctctgcttctccagtcgtagggactccaccccgctgtgttgattgctgtcatgtattcaccccatcataagcagtactcacatgtaaaacagtaccatgtcatctctgtggggctacaagtaggtggtgatggtgcaatgaacatataaaaccccagtgtcttcagtaggtgcgaaataggtgattagtgaatgatgaagagtagctgttgctgttttgattactatgattattattatgagaaactactgtggttgatgagatagatactggggagaaggatactattaatataatttattgagcaactttgttctgggcactagttgagtactttagggatattaattcatttaattctcccagttctgccatttactctctatgtgacctggactgttacatagtctctcagtctcaccctctctttttttttttttttttttttttttttttttttgagacggagtctcgctctttcgctcagtctggactgcagtggtgctatcttggctcactgcaacctccacctcccaggttcaagcgattctcctgcctcagcctactgagtagctgggattacaggcatgcaccaccacgcctggctaatttttttgtatttttagtagagacggggtttcaccatattagccagactggtctcgaactcctgaccttgtgatccacccgtctcggcctcccaaagtgctgggattacagacttgagccactgtgcccggcccttgccttctcttataaagtgaaatcattgtagctgctttggtgtggttctgaggacggtgagagaagacgcacgtgaagtattgagggtggtggcaggcacacagttcagagttactaacaatactggtgttttatcttcacaaggcagatctgggcccatagcacaaggaaaccgaggctttggcattttacagtaattacattgccagaacatttcccccactttcttgaatcatctttacctcttgagagatgaggaagagagggcacacctcgggcagaagtccaaagacctcaggcatttttggcctttcattcccatgattctggccaacatcattttagtccccagcagttcatagaaatattgtcttttaatctgatattcaaataatctgtgccttgaagaacctgtgtatggctctagaatcttttacattaatctactcaaccccactctgatgctcaaaacttcagcagtctgttttttttttattttaatgtctttattattatttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgaccttgtgatccgcccgcctcggcctcccaaagtgctgggattacaggcgtgagccaccgcgcccggcctaatgtctttattttaaacatttatttttagaggtagggtctctctaagttatgcaggctggcctcaaattcctgggctcaagtgatcctcccaccacagcctcccaagtagctgggatgacacccccaggtgccgccatcctggcagcagagtcagttttgatacatctttcccttctcattcttcccaatgtcatggattgggaagttactgtggttttagttgcagtactttttactctgaattctgtttgcttcctggaattctgtctgtcttttgaaaagacaacataaagaaatcgaaaaatatactttaaattccatagtgtgggagcctctgctactcgcctgtttgatattcattcccattttttcctttctaaaagaattccagattttttttgttcagggtgacaatgtgctctgctgaaaatactttcacagattcccttgcaggtgcatgtgaccagatcacagtaatggcacatatggcctcagtggaatttgctgaggagtatgtccctcccaagtaacagcaaagctttattagaggaaaaaacaacaacagaaaacctttcacctttgtcttgtttctcctgccttctgtctggaacttggacacagagtcttgaatttctgtgaccataaaacacgaggataaaaccaacgtgctcaggatggcagtacagaaagataggaatacgctggtccctgatggcatcatggaatatctgcagtggccctagcttcagtgtcacttcttaggtgagatacataatcctaccgtgtgtttaagccacggtttgacatgtggtctattctctgccgctgactgcattcccagctgttctatatggcttgctagctaatttaagtctagttttattgtcaaattgaccacattgtagattataatattaaagtacttcacagtctaaaagtgaactacttttgtaaaagccaaaggaaatgggccaaatgaaccattttgaacagagtttaaatgagtgagttgagttaccactcttggatggagaactggagacctggattttcagtctagttcttctgccagttggctctgtgggcaagtcacttgacctgagctcttttcctcccatctgcaaaatgaggtaatttgagctagacagtcctcccaaagaccaccaaagagctagcagattgaggcctgcagactcctattgaatttgccatccttgttcaccttgccaagacttcatagccaagaagccagacccagattttgttcattagctttgaaaacaccctttcagttgggtgtgtgtgtgtgtgtgtgtgtgtgtggtgtgtgacatgcgttttgaatataaattgtgaattgttttagcaagaaaccaggttgtatgtttctcaataaacatgcatactgtatattgatgaatttatccacttgaaataaatggtgccaaattgcctaaagtttgctgtaaacaggaacatgatttctcattatgatgtttaatttgttttagtctttgatctcttacatcagaattctgttaagaactctttttacctgaaagatcaaagcaaataagcagaagcatttataaaaataaggtatacgtggctgtggagagaaactccaggtatatacgatcataggctttttaaaattaataaactttgtttttaaaaacaaagcagtggaagttcacagcaagtttgagtagaaagtacagtttccatgtaactgctgtcctagcaaagatttttaagtacaatattttttaattaaaaagagaaaatataaaccgtgctaagccagttggtgaaaaaggcttcattatacttttagcactcttaacgcttattaaaagtttttaaaaacagatttttgtggttgaatcgcttacaatttctgatgtgtaaccttctaacatgtttcatcaaattttaaaagtaatgtaagcagtgctgtccactgctaaattttattttaatgttagaatacaatgaggtttctattttgccattagtcctgagagcttattaagtaaccagttttaatcctttaaaaaaccattctcattttgagggacacatatttcttagctttgtgcaatataagaagctaagaccatcttggcagtatcaaatgaaatgttttgcaagttagaaagttcagtaaccacttataaacataatgaacaattgttatagtcagtctaatgcagaaatacaggtgttgggggcaggggggtggtgggtgggcagacttggtccacaagtagtagtttgccaacctctgtcctaaacacaagttcaagaatatggttctcttggatagattttctgccagatgaaagtaagagtaacatccttagctaatgaactcctaatatccaaggcaacttttaattaattcaggcttttaagaaaagcttgtttaccaactcctcattaaaaatgttcagactggctggtcgtggtggctcatgtctgtaatcccggcactttgggaggctgaggcaggcagattgcttgagcctaggagttcgagaccagcctgggcaacatatctagaccctgtctctgcaaaaagtgaaataattagctgggcatgatggtgcacagctgtagtcccagctactcaggaggctgaggtgggaggattgcatgacccccggaggtcgaagctgcagtgagccattgatccaaccactacattccagccagggtgacagagtgagaccttgtctgaaaacaaacaaacaaaaagattaatgcagtacatgtccttttggtgaataagtaaatatgttttggtaactttagctttgcattataatctagtcgtcagcagattgactaagggcagataaaacaagatgatttggttttgtggtttggcacttactgtctgatttatgcccccaagaactcttgcaggccaaggtcgagtgtatctgatacctgctctggctcttctcacgaactgatttagtagctttgggccagcattagattttttaaactctttgacctatttgtacatgacaggcatttaatctttccagtagttacttgtcaaatagaaaagcatcacttcttagtttggacatttgcaaatatgactgagcagagctgacagatgaggtgggcatcttcaggccatagggtacttctggcctcctgtaacctagaaaattgggatgcctcagatatcaggtattcttccaagcagctagggttagtccctgacctcagaaaccctgagagccctcagaaaccctgagaaatccacctgggaatggtgtatttgttttggatgagattacctttactttccattctccaggtcttcttgtgttttttgtttttgttttgttttgttttgttttatatcattctatgtaaaagagaaatgtggtatcatttgcattatcatgttatttctttccttataatttatatcttaatgcttatctctggggctaggttataatctcctgagttaggtagccttaggtttcttggcggagattcctcccctgggaagtgaggtttataaaagaacccgtgatgtggccctgtggagctgcatggggtgtgtgctcagtactcactggtttcttccctgcaaagtgacacctgcagcctttggggtaccatgtctcataatttttgcattccctgcaacacacactatactgctatgggcatcattgatcattttaaagatttaaggaatgacaagatacagtgcttattctcccctatgatttgcttagatttttatctaaatagtacttattgaaataagtacttcagtatcatgctacatcttacatgtttgagctagaaacagactaaagtttaaacccttttatgagaatgaaaagttacttccttccccttcttagggcttttaatccctctttatgttgcatttcagaaaatgccctatagcgtactatgaaagaaagacattcattcctgtctttgctgctgtgtggacgatctgtattccttgctccgtgggagttgtgggtttatgtctattcttgcatgttttgcctgaaggaccacagtgacctacttggtggtctccctgctttcatggtttcactatgctgatctatccttcacttaattatagagtctatcttaaaaaaaaaaaaaaaaaaaaaaaaacttttggcctatgttgcttcttccaaaatggcatccaaaacctaagcctctttaaaattggagtccagcatgcttccccagtgctacttccttctggactccctttgccacttgctttctgcttccacccatatccagatgggctgcaaatatgccttgctggttctttactctgtctttgcacaggaggctccctcattttgaagggtcttttgctacccatccatccatccatttggattctataatagagttcttgatgtttgacagaactaggccaggaattgtgggggtataatggcaagcaagacagagtctatccttacgttatggaagttcaattcatttcccatgtggcatactacttctcaccattcagattcatctcgaatattgtttcttctttgaggtttttcccactgcacccaagatactggcctgacactttccttatctctattacagaatttaacttgttcattcattaacagatatttattgcctactatgtgcaagaatctgtgctaaaagctgggaatattgcagtaaacaaaaattaagtttacagcttacatataatgtggtaattatccatcttttaccttcattagactgagttcatgtaggactttatgtaatatctttatatcttcaataccagaaatgcctagaaataatttgcataatatacattttctttaaagatttaacaaaagtctgagggacagttttcagaataaactgaattaaactctctctctcttatgtgtgttatgtaaacatatatataaaatacacttttgggttttttgcttaggaagtagaaaaatgctaaaatttctgttacttacaagcagattaaaatgtccaagaaagaaaagtagggatttatattgattctgctcaaatgcttacctagacaatgtcaatatttatattttactcccctgttgtagtagaatggtaattggttctctagttaagcagcttttttaggattaattttgaagcaagaaattcagattaattaagggacaatttcacttgcagcatttaggcattattttaaccatcaaacttgaagtggcaagaaacggagttgcttaaggaggccagacgtaacattctaaaggtagtagggtcttgattgggttgcttaggcattaaaaggctgtttaacttgtcttgaagtctatctttccttgatgtcttctgcggtaagaacactgtgatacagatggaatgacgggaagtggttttcctttctttcagttggtgagtttgtaagtgatgcccttctcgttcctgacaagtgcaaattcttacaccaggagaggatggatgtttgcgaaactcatcttcactggcacaccgtcgccaaagaggtaccagcccataaattctttcttattgcaaagtgaagatttcctggggacgtgcttaatggcattttaggggtattttgaggcaacagctatgttgataagttatttaagaaaaaaacccagtgctactatccgtaacccagattttagtttttagagtgattttaggttcacagcaaaatcgaacagaaaatagagttcccgtgtaccccctgtccccacacatgcgcagcctccccatccatgaatatttttaaaaagtcaaaaatagggccagttgaactagattcattatgtgcctgtgccgtgtttcgcaacttaaaaatataagttgtctgtgccatgccttataacttaaaaatataatctctaatagttataactttaaagtttacccttcagattatttttatgcacctgttgttttcttttgtcatatacaattttttaataatttagccttttcccctgttatctattagtgaatacagtggtagaacagtgaagtagcttttttataccagcctgaaagctccagttagaattcagtttctcagttataccatccagttttatattcagcaggccatgcctaccatcttgatttttccacagggtgagtctgaccgagcacttggttaacctctgcttttggctaagccaataaaagatgtaagatacttagcatgaaaaggtcactgtgtggtaagaccaccttcacagctgctgtgtccccttgataggtttcctaataaatttatataggtttatttgtggcaagatcagtcttaggctaactagaattaggctcctttatctagctcatagtgcttcacttgagtcaattttgatcccctgtccctcaccggaacatgtctggagacattttttgttattacagcttgagggagtggtgttactggcatctgatagtgcccagaggccagagattctgctaaacatcctacagtcaacaggataaccacccgccacccccaagaattaggcagtccaaaacatcaatagtgctggggttgagaaatctgatctagcttagcttaaccattgtatcatagctttatagctgttagacagaaaataccactgaagatttagtattattttatgcctcttataaaatagtatatttggatccactgtagaataaaatgttttttatgtaaaaatgtgttttggaggtttaagagcttgctgagtttaagaaaacaaaccaaataatttgaagtccagctacctatttgataacctcattttttattccttctgtgttttcaaaagaaaaatcctttgtctctaagaaacggaaatgactcccataaggtcaaaatacagtctgtaatattttcattgtctacctttatgtcttgaattattcatccttcatttatcactagtggatgctctcagaactttatgctaatctagatttgtgcaaatttagcaaatcccagaaaagcaaaaagacattcaaggagaaatctctaatgactgtaagttctgattcttagtggctgcaggggataatttcttctcttcccaggattgttactctgaaagtgaaccaagagagtcagaatttctaggataaggcaggtccatgtgagataaacttccatctgtaagggaggtaggagtgagctggggatctacctggaatgcgcacaatttctggatacacgaattaagccagaaggcattaattctctggtatctgttcaccagtggagactgctacatcttatttcccaattagtttccattccagttgttcgtataaacctctattatataacatcgtggtcttattaaataaataataaacaagaataaaaagagtaccaaagtgtaacccatgctaaaaaaaatcctgttgtaaattcactcaaaaagcaaataatcttttcctttgtgaaattggttcctaatatattgggtctgcatgttgattattttatgtggagttttcttacaatgaaacacatctactctaccactcactgttttctccttacactttgtagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggaggtaaggtggcctttgtgttcagcctcagagatgctgaaacatcttgtatggagtatttgtatcctgtaaattaatctttctgtttatcactgaaaaggtctctgcccactcccatcagagtctgctgttatgcaaaaatctgaactatgaatttttatggcatcctgttgaattaataatatcagtcacccatcacagagttaattttaactatttaatattaaacttgggatcaaaatcccactgataactatcataggttactggtagttctaacagggagttgaaataataatggcgttctgttttggtcattaatttaaaaatatttttaaatgctctctgggattgtcagtcattagtttaaggtgaattttcgttaaaggtttggtttgagattttgggcgttctctgtgtggatgtgtaagggtttttttttggccttttatcatttcttttccttcatagtggaagtcaaaggcattaataaatgcttgttaattttttttaactacctttgatttgttgattgtaaagaaacctattttcgcctctttttcttagggagcttagtcccgttacttcttacctgattctcattcttaactgaaggcaaacatctatattcaaatcataaaattataaaatgagaatctttgggttggaaatgccatctggttcaggcattgattttatgctgtctcatcccccgaagggtgatgattgtatcacttatcttattccttcagtattctcttagatgttccctagagctacagatttccaaacagcacattcaataggagttgtaagtttataatcggcaaactacaggatgcttgtttttttttcttttaatttctggtgtaatctgctactagggcccccatagagtttattgtctatatcagctagaacactgggaccacagtcataaactgaaggatccaggcaaactgggtcatatggttacccccaccaattacagtcttcagtgatgatgtcactatccaggttgatattcagttgaaatgctagccagctccttcctagttaccttcatttacatcccatttcagtacctgaacacagtcatgctttagactctgaaattccttagaaatagtaccataaggtttatagctttgatattcctctctgatcatgatcttccctcataatcacctccccagttcaggcttttagtccattatcctctttttccctgcctgcctttctaatcaggatggaatcaatggataaccattcttacctattccattgaacatccttgacttggctgaaacccttcacattttctaaacatatttttgtcaattctccatagctaggaaaaattaatttctttctttagttgcttctgggatttctaaagtatcaagtcatgtaaccttaccacttaattccatttcttattcatgctgtaacatcagctgggatcttaatgttactagatgcacctaattatctctgtcttgatgacctatcatcttccccatagcagttgatccagcccaacttcattctccttggttcccagcgtaactctctctcatgctctacagatgacccctccaccgtcatccattgtgaatttctgcaacatggtacctgacatttggtaggtgcccagtacgtgtttgttgaataaaccattgaattttctcctgtacttcagcaactcttgtaccttcttctatccctttgtttcctgtcttcccttttatgattatgttctgctggactctcaatcatctcctctccctttcttgcattttcagtctccctctcccccacacccccaggcttcatccaccctcctcccagataattctttcccatgtgttactatctttctactatgtgtttttaatcctgttgacagttggtaggaaatatttgatggtttattctacctgtagaaaagtccaaattctcttgcagggcattcagaagtctcttacatggcttcagcctgcattttcagccttatacatgtatgtgactctcctggcatcctaaaaccattgaccttttctttctctaggctttcattcccaccgttctgccccatctgaaatatttttcctttttttgtcaaatggggttaatgtatgataaagatatttgtcaactctaaagtgccacttcttatgacccgtcaaaatctatatatttataaatgttcacctgaaaagatgcagcctttacaagtctttacaggtgccttgctctgctatactacccttgctttacctttttcttataagaccataacttatcttccaattaattgtagtcatatctctttttatctgttagaatccaaactatagtttatgtgtctggtatgtcttgcacataggtcctcaataaatattagacaaagtaaattgtatattttaaattttttttcatagcttttggtaaggacttcatggtccacgattggatattgtagaaagcttatccagcccactgcccaggacgactttgaatgcggaccaacacaaattcataaactttcttaaaacattatgaaatttttttgcctttttttttctataggccctgttatagagcctcccatcttttagcaaagaactgtctaatacaaatgtaatgtgagccacatactttttcgttttctttttttaagatggagtctcgctctgtcacccaggctggagtgcagtggcgtgatctcggctcactgcaacctccacctcccgggttcaagcgattctcctgcctcagcctcctaagtagctgggattacagacatgtgccagcatgcccagctaatttttttttttttgtacttttagtagaggtggggtttcaccatgttggccgggctgatctcgaactcctgacctcgtcatccaccaacctcagcctcccaaagtgctgggattacaggcttgagccaccgtgcctggccttactttttcattttctaatagacagtttaaaaatagtaaaaagaaacaggtgaatttaattttaacaacattttatttaatccagtatatctgaaatatcatgtgaccaatatgaaaaatttaataagatagttcacattctttttttatgtttctttctttcgtaagaagtcttaacacttcttttaacatttaacagcacgtctcaattcatactagccacacactgtgtttgatagttacatgtggctggtgactactatatttggacagtgtagttcctggatgacttgaaatttcttatcactctttatttttccattaagacagacggtttgtataacctagtaatgttttctaaggctgagccactgaatttttattattgtttttaactattcttgtttttaaaatttaaaaaaattggtttggattcagtataattagtatatcaggtcacttgcaccattttattttttaacttcttttcctgtagccctgcaggcgggcagggcttctttcatgtggacaaaaccagaaaggtgttgcatcactgatccacacacaaggtgggctcctgccaactggcagcctccttgttccaggaaccagccctccttttgacacttgaaatgtaaaatcagaatagaagtttaacgtacctgacttaaaacatcttcaggggatgctacgtgacaattcttgaagaaggagaaacgagctaccattttcctggaaacaatatttgattcacagtattttgttgtttggtagttaatgaggcttgttttgatagaagatgagtgtttttctatcgctaatggggcatttagagaaacattccttgtaggatgagctctgttttatgacctcattgaaaaagaggtatgaaaaagaggtaaatctttaacataggcaaaacaggtagtgtttcagaaatttatgtgtaaattaccgagtatatttttctccagtgttgtaatggtcatattctcagatcacctcaaaatacctatttatgcagtctgtaatgtagcataatccagactgttactaacattatgtagcataatgttaataataataattacgtacataatgttaataatacacagactccagccatcgtgggtaagatttttttccatgggaaaattcatttggaaagctaacttgtaagactagccaggtaggcagcctagccctggaggcagagctgctcctcacctggaactgcagaatctgattgaacccagtggtccatgggggttgctgaattcgtaaagcaaatgaaatgttagaagaccctctaattgttgtagagtcacacttttcctcttgcagaggaggtactcacattttttttaagaaacaatctttaattatcgatgtattcttttaggtttaggtttgcagacactggtgagcgtgtgctgagaggtaacttgatgtatctttctggataattagatgattttttttttctatttctttgaacattttttttttaaagagctgcttaagatctggaggagtgattccttttgaccgtgtcttattttcattaagactgtataacttggaagagtttttttttttctttttctttttcttttttttttaagatgaagtttttgctcttgttgcccaggctggagtacagtggtgtgatcttggctcactgcaacctctgcctcctgggttcaaacgattctcctgactcagcttcccgagtaattgggattacaggtgttcaccaccacacccagctaatttttgtatttttagtagagacagggtttcaccatgttggccaggttagttaatgttactctctggtttggggggcagtgatatgttttggcttttttcccacccagatctcttcttgaattcccatgtgttgtggaagggactcggtgggaggcaattgaatcatgggggcaagtctttcccatgctgttcctgtgaagtgaataagtctcacgagatctgatggttttaaaaagaggggttcccctgcacaagttctctctctttgcctgctgccatacatgtaagacatgacttgctcctccttgccttccaccgtgattgtgaggcttccccagccatgtggaactgtaagtccagttaaacctctttcttctgtaaattacccagtctcaggtatgcctttatcggcaacatgcaaatgaactaatacagctcggggtggcttgtgtgggtgcgtatggccatgtatgcaggtgtgcgtgcattggaatatacaattccgtattgaacccagtttaaacttcatcagttctggtgattgctggagtgtcacatatggcaagacgtcaccttgccctctaactacaccagaaaaccaggccagcaccattgactatctagatacagtgggccgtttatattattattgtttcatatttttagattatttggtaaacaatttacagaactaagaataaaggaatagtgagaaataactattagcaattttaataagagttaacatagtaaatattttaattttacgaagaatttaaatatggtaaacccacatgtttattctgtattttcccagttttgaaggtatggatttctgaaatgagcattatcctttggaatgcagctagctgctaatcacctgccatgcacgaacctgaaatatatccgtcttacaaatactggttctacatttcaaatacatctctattaggttcatcatatttcttggtcttttttttttatacttgcaatttcatttaattattgtaaaaatttaagatatttaaaacattgacagctcataattttattgaagagagaatatagccatcttccctcaggaataaaatgttttcaagtttggatttgtaaacagctattaaaatgatcaagccagtctttttttccccctttttttctgcattatctcttctaatcaccttagagagattcctgccttgggcatttgtccacttcctaatggtatcaaataaatgtgttgcacagacataaaatgtgttgcataagcatcataaaatggcaaggaatactgtcacatcattttagcaatgatggttaatgtttttgtcacataatattgagtgatgatatccttcctgttgaatgactaagtggatgagaataccatatttcctttttattcttagaaatacattgctcagccgggcgcagtagctcacgcctgtaatcccagcactttgggaggccgaggtgggccgatcgcctgaggttgggagttcgagaccagcctgaccaacatggagaaagcccatccctactaaaaatacaaaattagctaggcgtggtggcgcatgcctgtaatcccagctactcgggaggctgaggcaggagaatcaattgaaccagggaggcagaggttgcagtgagccaagattgcaccatcacactccagcctgggcaataagagcgaaactccacctcaaaaaagaaagaaagaaagaaagaaatacattgctcacttgtcaattcttgagcttgagaaaattcatctaggatatcatgtgaaggctcatagcctaaggttttacttacgtgatcaatttcattcttcttctggtttatctaattggtaaaatgcctccttctgtcagttgttcctatttgccaatatgtggaagatgatttttgactatattcagtgagtctccagacttctttttatcatgctttttaaagagatgggacctcactctgttgcccagacttgagcgcagtggctattcactggtgtgagtatggtgcattacagctgcaaactcctgggctcaagtgatcctcatgcctcaacatcccaagtagctgggactatgcagactttttttaaaccatcttgaaagatgatgcagtactttgggaacacagcaataaaaatgtgataatttccctattgcatcacctttctaggcaattatatcattctttcatgctcatattattttgtcttctttagcacagtttttaaatagttgatggctaatgatgaaataattcttcggatgataaatattttgtaacataggaacacaatataggaaaaagatcgaggttcataccatatctcagactcatggttaagtacaagctagaatgagttttagtcgattaaatttctttttctctatgaatggataaagtgagaatatcagcccacaagtagttagaagtgctcagaactcaaaggtaaaattgtgtccaagacctgatggtattctaaaggttaacagcctatcctacttaccaagaatttacatttattatgaggcctgtacaacctgatgcaggaaaatacttggcataattttctataagttaggtagttaggtgctcaacaagtatttgagttgaatcacattggcattcacatcaaacacatacacctacgtcatcatgttaacttaaggttaatagtgtcaccaaaactaactggtctttaaaaaagaaaaactaggccaggcatggtggctcatgcctgtaatcccagcactttgggaggccgaggctggcagatctcttgatgtcaggagttcaagaccagcctggccaacatggaaaaaccccctctctactaaaaatacaaaatagccaggcatggtggcatgtgcctgtaatcccagctactggggagactgccagagaatcgcttgaacccaggaggtggaggttgcagtgagctgagatcgcaccactgcacttcagcctgggcaacagagcaagactctgtctcaaaaaaaaaagaaaagaaaagaaaagaaaaactaaggaatatcattctagacatgcagtaattaagtaaaattgcatcaggagtctaataacatagcatgatgggtcccatgtttcattatttccatgggcagaagagggatggctacattataaataaaggaaaattgtaagaataagaaaagatgaagtatgaaatatttccaactcaaaaacaaactgtatctgagcatgcagaggtacaaaatgtcacctttttcctccagtgtaatgaagggcactaaacctcttgagcatttgatatgttccagatactatattaaagtgatttttttttttaggagacaggttcttgctgtcacacatgctggagtgcagtattgcaaccatagatcagtgtaaccttgaactcctgggctcaagtgatcctcctgcctcagcctcccaaatggctaagactacaaacacattgccaccatgcctgcctaatttattttgatttatttattttttttgtagagacaggggtctcactatgttgcccagactgttttcaaactcctggcctcaagtgatcctcctgcctgggcctcccaaagtgttgagattacaggcatgagccaccacgccagaccaaggggtgaaatcttgataacaataatcaatgcagtcatcataaaacgcttgcacaggctcaatttgtaggtggcacagtgctacatctagtcaaaagcaaatttaattatggtcattgtgctctgagaacttttctcagaaaataataaccagatggtattatagatggtgcatttcacaaatacatgatttgtagttagtgaaaacttgtcattcaatcatgtaataaattatgcacatgccgtcttccacttagctagtgatgttgaaacattcatagccttacctgatgagctcaggctgtcatgagaatttatgtctattcagtactttgtctttaaaattaggtgagagagaaagagaggctgtatttgactatatatctttttatttgtatctctggagttacaagtttttgaatatataatctttcagctgcctttctgcattgcattttgagaaatgatattaaatgctcaaggaaaaaaaacctaacaactttagagggccgcaaagtgaatcatacaaaagataaattaaagctttaaatctttgccagtggatgagtcaagtaagagtggatttaatgaaatggctcatggctttgagaagcagctgtcataatgctgggttggcagcttccaggactgtgtgaggctttctgactgtctatactgaaataggagaactcatttgaaaatgacgaataggagaatagcagaaacttgcattttcttttgagggaactggctgccagttttgaggtccttatttagaaatgctcgattcctgtattgaataaacttggactacatgtatgtcaaaaagaaaagcaaaacacttttatagccttaagcagattacagatgtgtggccaaaccagtggggtctgtttttgtttccaagcaggtgatggctggaagaggagatgcctctgtagtgcagggcttgagttgctgctgtctgagctacatctggcaatgagactgtgctgcttactgagacctaatggcacaggttgccccagtaacaggatattgctgaatgagaaatactgtaggattcatttgtaagagttatttggagggttggattattcagtgctaaggatcctaagctactgatgcatggactcttttcttccctccagtatcttttaattaaactgtacaaattccctggcttaaaaatagtaggaaaagaggaagaaaatacagattcttatgattttaactggtctctggcaatagtacaccgaaacattaatttcttgttgaaaccatctggatatttgtatcttcagtgtaaaacccctaatttagataggactctccattgtgacatggaaaaataaccctttaattagttaattaattttactgtggcctcaaaatctacatattagcatatcaagccaaaaactgttggctttacttgggagccatgtggcttaaactagtaccagtaacttaccacaaggaactcagcaaaattataagtccatgtttgttttggaaggaaggcaattattacgaaaataatttagagatgttcaaactatttcctttgagtagaggtagagagtgaacaaaatctgtcccaagtgggagctaactagcttccttttttgccctccctgtttacaaagtaacacttttagtttactaggtaacatttgcagtatccccagtgtttcaatgtaaaattgtaggtggtagactaatgccacttagccaaagccatgatcacctgaatttttaatatatatttttgtatggagtgagatactgggagaacagtcttcattagcttaaactctagaatgtactgtttgtttgtttgtttgtttgtttgttttgagatagagtctcgctctgtcacccaggctgcagtgcaatggtgcaatctcagctcactgcaacctcccctcccaagttcaagtggtactcctgcctcagtctcccgaggattacaggtgcctgcttccacactcagctttttttttttttttttaatggagacggagtctcactctgttgcccaggctggagtgcagtggtgtgatttgggctcactgcaacctctgcctcccaggttcaagcgattctcctgccttagcctcccgagtcgctgggattacaggtgccaaccaccatgcctggctaatttttgtatttttagtagagacgaggtttcaccatgttggtcaggctggtctcgaattcctgacctcaagtgatccactggcctcggcctcccaaagtgctgggattacaggcataagctaccatgcccagccaagaatgtacaatatttttaaagaaatgcggtttattaccataaaatacaggttgagcatccctaatccaaaatctgaaatgccctaaaatccaaaatgttttgagcactgacatgacagcaaacgtagaaaattatgtgactttatgtgttcaatgtatacaaacttcctttctgaaacaaaaattatttaaaatgttgtataaaattgccttcaggctgtgtgtataaggtatttttgaaacataaatgaattttatgtttatacttgggtcccatctccaacatatcttatatgtatggaaatatcccaaaatttgaaaaaaatctgaaatctgaaacacttctggtcccaggcagtttggataaggattactcaatctgtaaatacagtagctcaaattgattttgtaaggcagtcaagttattatttatagtattttaatttgtattattcttttaatatagcaattcattttatatatttatataaataaattttttgcaattgagcaaattaaaaaaattaagtgcttccttcagatctacattttattttctatttgttatcaatttaataagtaaaggacacacagatcatctgattgtgttgtcagacatttgaaggtgcaactgatgaatgttcactgttgtactttgttttgtcatgtaaattgttttaaagagaagtgaatgttgagcatatagtaggccacacgtgcctgtggattggctcattgttttaggaatgtgtaattctggaaaagatttgccaagggtattcaaaagtatagtttgatattagaaattatttgaaaataatctttatagcatagcaccattttatttagatcaatagtaattcaagcagtatacataatttgctattgtaagcgtagcatataacctaagttttcttttacatttgagaccactgtttgctgttggtcgaatttggtcttccaagattttttgcttagtgacctaattgccagcctttgtgaagagctgttacttattgtcaaaccaggcagtaagggtttgcttttatctttttatcagttctttcaatgctagtagtcatgagattaatgtagttggatactaaaatgttaatacgtgttagataacaaactgggaaagagatgaatgacatcatgaaggaaagggcagtattgcacttacagtgatttcatgatgatagaactaacctgcctaaaaagacattgggtggaaacagaaaccaggtgtaatagacgcatccaagtagtcaaggaaagaaaagacttgtaagtaaataagataatctttgcttcaaaaatatcttcaaaggtttaaaatgtgctttaccctcatatataatctttttgagcctatttctttacctcaaacatggggaaaattgcaataatctgtatcacggtatttgcttccaaaacgactaattggtgtaaatgcatatcaagccggtaaagtttacagtggacttgtttaaaatgcgtagattggaattgttgggggagcaggccagcagcatgggatgttttttttgtttgtttgtttgtttaagactctgtcgcccagactggagtgcagtggcacaatctcggctcactgcaacctccgtctcctgagttcaagcaattctcctacctcagcctcccaagtagctgggattacgggtgcctgccaccacgcccagctagtttttacatttttagtagagacagggtatcaccacgttggccagactggtctcgaactcctgacctcaggtgatccgcctgcctcgggctcccaaagtgctgggattacaggcgtgagacaccgcgccagctggggtgatttttttcttagtcaaatcacttctctacccatcatctcacactgtcgaatacaaagactctccttggggctcaatgactcatctcccacctctggtttgataatcatggctattataacatgttccctttttaattagttattttaaaattattgtaggtcttgtaatcataatcaataataatacgtaatggctccttaagcacttctatcctagataaggttgagaacattattaaaattagttttggtagtaatcaagtaatgataattcttatttatgaatttaaatatgtaggagtttttttattttagggaagcaaaaaggactagaaagtatgatgtctcatgattagaaaactgctataaaaatgaaggtagaattgatttgggctgttttggacattttaaatagaaatttaaataggtattcaaatagcaaagtcattctactttaaaacttctatacttttttaggatcttcaattttatatttaaattatatttttgaaatggttttagaagaaatattgtatcttaaactctaactactaataagtaagagaagatatatcaaaggtttgatcttttatctcctagaatatactattcattcgtttcccattgtacgtcatttgaatgttaatggttagcctcaaatggttttcaacataattgtatagctactattattggaaaattggagccaaggactcatacacatatcagaagtggtaatgaagcactttggttttatgaaaatatgtttacaaggtagtcacaggatagcaatattgcatttactgtaatacaatgatggtggaactaagtgcagtggaacaggatgctgagaccacagttaccgcatctctaagtgcctcgtctagttatggtccaacctcagatataactcattggtgttgaaacacacctagcaacattttaagcatagaccgttcattaaaaggtacctttttaaaaatttttatttttaaaaattgacatgtaataattgtacacatttacagggtacacagtgatcagatcagactgatcagcatattcatctcaggcatgtatcatttctttgtgttgggaaaattcaatatcctgcttctagctgtttgagattatgtcatatattactgttaactgtagtcatcctacagtgctgtagagcactagaacttattcctcttatctagctgtaatttggtatcctttaacaaatctttctctatcctcagtttctacctacccttcccagcctccatcatcctctgttctactctttacgtctatgaaatcaacattttctagcttctgcatatgagagcatgtggtgtttaactttctgtttttggcttatttcacttaacatatgtcctccagttccatccatgttgcttcaaatgacaggattttattcttttgtatggcttaatagtatttcattatacgtgcatgcacgcacggacacacacacatacacacacacacacacatcacattttcttcatccattagtctctttggacatctaggttattccatatcttggctattgtgagtagtgctgcagtaaatatgggagtgcagatacctcttttaatatactgatttctcttcctttagataaatgcccagtagtgggattgctggatcgtatggtagctctatttttagttttttgaggaatctccatactatcctcaaatggttgtactagaacagagcttttttaccttccttccatttgggaatcttcttacccaacatgtatattagtaacttggctatgtatgttccattctctgtctcaaatactgtgtctaggacatctgcaatctttggctatgaccacgactgtaaagtgcatgacgcttttgctctgtcatcagtattagttgacaggcaagtaagatagtacttctcttcataacccctttacctgcccagcagaataccagtacagacagacccagaatatctctgggctcaagaatccagacatttataggatgggacttttatctataaatcaccttaagattagtaagttcttagaattggttacctttgccatttctcagaagccctttgtctagtaacctgtgtgtcactgtcatttccagcctgtctttcctacacattgtttatgcaggctttaggagtgcccaccccccagttctaccccccacccccaccctagcctttgtggttttaattatcctgtcttggctgattttgttttgttttgacatttcatccattaaattcctgacactggctatctctttacaattattatactatttttctttctggctcgctcttcctgattgctgtaatccatgcccttgactttaaataccatttgtaagtagactaggccaaggtttatttctctaggccagactctacctagttatttcataggcatatgaatcctaacatgtccaaatgagagttcttaattcccctgctacccagtcctcaatgtggttctctcaaagctattctatctcagtaatggtcctatgccctctcctagggattattgctgagaacctagaactcatcatcgtctcttctgcacatcctatgaattctggatttatccacttatctccatcttttccagcactaatctaaactcccattgtttcttgctggagttatttccgtatcctgctaatctctgctctcgttctctctccctgacacatgcgctgctttcttctcccacaccaagccattctctgtacagcagccaggatgtagagtgtttatttacataaagcagatcctggaacccccaaatttaagttgtgttcgtggcttaccaatacgcttaaaaaccaagtgcacagagagaaaacaatgaagccttatttggatatgctgaggataattgataacgggtaacaactaacaaacacgtagttggtgtcaggtttgacctcctacattccttacaggtattagtgtatttgacccagctcctccctacctccgcagtatcaccccatgcctctctttcccccgactctcccctgctcagtgtcacacaagtcaatatccccagcttgctaacccccgggctgacagatctcattgtctataatggatgttccaaggtcccaccttcagcctcagttttgttgccatctttccagaatgaattcccttgatcattctgttttttggagacaaggtcctgctctgtcacctaggctggagtgcagtggcatgatcatggctcactgtagccttgacctccctggctctggagatcctcctgagtagctgggactacaggctgcacctggctaatttttttttaatttttagtggagacaagatctcactttgttgcccaggcttgtctcaaactcctgaactcaagcagtcctcccacctccgtctcccagagtgctagaattacaggcatgagccaccatgcctggccctgatcattcttttctgaagaaaacaccccttcttcattattctcaatcctagcagcctatttacttccattctgaaatgaatcacattttagtattttattggttcgttgtcgttctctccccccatagaatgtaatctctctgagtacagggagcttatctttttcccttttggagcctcggatccagcagaatgccagacacttagcagccactagcatttgatgagtgaatggcttttcatacacaattttagacattgttcctgattggtctctctagtcaataatagatttatcaaatctaatcgataatagatttctttttcttttctttttttctttttctttttctttttttttttgagaagtcttgctctgtcgcccaggctggagtgcagtggcatgatcttggctcactgcaggctctgcctcccaggttcacgccattctcctgcctcagcctcccaagtaactgggactataggcgcccgccaccatgcccagctattttttgtgttttagtagagatggggtttcactgtgttagccaggatggtctcgatctcctgtcctcaagatccgcccgcctcagcctcccagagtgctgggattacaggcctgagccaccgtgcctggccgatagtagatttcttttattgattagagagactaatcagcaacaatgttttaaaattctcacatagatctctgaatgggaaagcagtcttgaattatgcttgcagggagagagaggggaaggaaggaggaggaatggtataattagacttcataaggctagattttgtttctacttaaataatggtatcacagtgggacatattatccatgcagaaagtgagtgggcatctggtctattatctgtggtctttcaggaatggcagctctttagtttaaaaaacaacaaagtgcagcactgtttatttaatggaaatagaaaagcagtgcctgtgtattagtggctcagatttttttgttctttgttttcagctgtctgctgtatgcctctccagcggggtcttacagaatctcaagtctaccatgatcaaagctgaacccattagctccatttcttaattcctcctgtatcctctgttaccattagtaactattctccaactcaaagcatcagattcctcctcttactcactcccttcatccccagtcaccagttctgtgctgttattttatccaagttctcagtaggcttcacgagcaccgccttcacatcccaactgtcgctcctccacctatctgtcctccatgcttctgctagctcatgtttgttgcaatacaactaaccttgccactcttctgcttcaggcttttctactaggctctgcatctagatgatggtccagactcctcagcctgtgaaacaaagcccttcataaaagagcagagctacagctagtcagctcccttcctgcagtccaccccctcctccaccatactgagaattggcaattcctgtagcactctttgtatgagtccattttcacactgctataaagatataaccaagactgggtagtttataaaggaaagaggtttaattgactcacagttctgcatggctgaggaggcctcaggaaacttacaatcatggcagaaggggaagcaaacacatccttcttcataaggcggcaggaaagagaagagcgaggagcagagtgggaacagccccttataaaactgtcagatctcctgagaactccctcactgtcacgagaacagcatggggaaaccactcccatgatccaattccgtcccaccaggtctttctctagacacatggggattatgaggattacaattcaagatgagatttgagtgaggacacagccaaaccatatcactcttcatctgctacgggtgccattccctgtttctacagtgtcctgtttgctaccttctttgtagatttctattcattcatcatgtcccagtttacctgttacctcttcaacagattattcttcagtctgtccctcccaaactccaccaatgaacattctttgttcagcccattattgttaatatgcacttcactgaaaacactgttttatgcttgtttacatcccatctctgcagggctctgagcctatagtcagcagttgggaacttactaggcatagcgcccagtaaaggatagctctttatatatatatatatattttttttttttctaaaataataagccccaagaaaaacattacctgtgaaaaacaaatgatatttttataccattttcaaaacctaatagcaataaaaagaaaagaaatgtcataagtatacatttaagctgtagttaaaaacagtaaataggcacagtatttaactcttatcatgtgctgttccaagtgtgttatttacatcattggctgttcacaccatcccctgaggtggttaatatttccatcccatgttaaagatgaggaaaccaagtcacagcagcctaagtgacatgttcatagtcacattggagctggcaggtggcagcactgagaatgaaacccacgtggctgagctctggaaagtcaccattaatcaccacactagaccttctctctaggatctacataactagaacatacaattaactggagtatatgtaagtgtagtcgttccttgagaaaggaaaagaattcacaaatttcatagcctcatcccttgtgcatttgtggcattgtgctaggggtgtctatttgatatttgaccctacagatttctcagatgccaaccaaccacagatactttaaaaaaagatacttaatacttaccaatgcaagaaagtgggcttgttggaagaggaaaaatgttagctcactaatggaaaatcaactaaaagtcttacctctccagaacatgcttttcctaaatgttgtggctaacccaagaagctacatcatctttacctttatgatacaatttaaagtacttttctacttacttcaagccctcagagcacagaggcaagggaggccttgggctataaaccctgtagcctgagccacatggcttcttctcctggacagatacctggcatattctgccactgaggatcagtggtgcagatgtatctgttttctcctaggaatggggctccacttacgaatctggggcaggacaaggtattgctgcattttggggagcgtgctggaaggaggagcagagtttgttgtttttgcttcctgatatggactggctgtgtctccattcaaatatcaacttcaattatatctcccagaattcccacatgttgtggagggacccaggggaggtaattgattcatgggggctgatcttctctgtactattcttgcgataatgaataagtctcacaagatctcatgggtttatcaggggtttctgcttttgcttcttcctcatttttctcttgccttttcctcatttttctcttgccgccaccatgtaagaaatgcctttcacctcccgccatgattctgaggcctccccagccatgtggaactgtaagtcccattaaacctctttttctccccaatcttgggtatgtctttatcagcagcatgaaaacagactgatacacttccttaacagaaccaattattttttcccaaaaaagagggggagaagcccagaagcatgcagcttctctcttctttctaaggaataggtcttcacaaagtgcccccaaaagaaaaggaccaggcttttctcttactttgtgactttcctaggttgctttgtagccattttggacacagaccacctatagctgtgtagtagttctcatgtgtatggacacagtggaaggagatgccaggcacatagttcttgctgcattgacaccttttcagggcatcttcttttaccatcttctgtagaaactgcaacagcccggccaactaccagccccagcccacccctagctttgctgctttcattttctctgtaacacttgtcaccttgtaatgtgctagtgtaacatcgttgttttagttttcttatatctttccttccctgtagaatgtaaataccaggaaggcagggaattttgtctgctttattctctgcagcatccctagactccagagcagaccctggaactcaaatatttgttagacagccaaaggtcatatacttccaactctccacccaaaatatatatggatcacccatccttagtagcagctaaacctttggacatgaggaatttgctcgttcacagttttctggcctagcatctgattaaccaaactttttcacatatcaagaatttaaaatgactccaaaactttttatgaccttaggtgcttctccttaattctagttggttcataaagctgtcagaacaataatctgcttttgataatatatgacttttcttgcctccaagatagcctttaaaaaagcaatttagccttttactgtaattatattccaaatttaagtcttgccagaatatcattttccccctttaaacatactttttatgatgccaagatattttaaagaaaagttcagataggaagcatatttaagatgtcagtatatgtctctaaaatctaagaacatttttctacagagtccagatgataccatctcacccacaaaattaacataaatttttagtaccattggataccatgtccatattcagattctccctgagttccagaaaggtccttcacaggttatgcatttcacatcctatccggcaccagggccagcatcttacatccttaattcttaggattcagaatagcactttttatatcctgacactgacttgctgaagaagctgtaccagttttcctataaactgtccactccttggatttgtcttatatcatgtcccaggggtattgtttagattgttgctctattgctaggatattcatgttaccctaagtgtgtactgagatagcagagtaaagagagattgtcttttaaaggttctgcccaggaactgctggtttacacaaaagctgggctttagtgcttctcggatctctttgcttgtttcagtaatttttttttagaaattcactaattcactaacgtaagtggggcagggtttacaggagcatgtgttgagagaagttggtttgactttaaatggtcatttttacaatccgtatttaggccttacaggtcgcatacaatctctgtcacatattgctgtcatttttaccccctttcttttctttttataatcctttaaaaaatgcaaagcccacccttagctcacaggatgtacaagaacaagttgcgggttgcagtttgccaagacctgctctgtgccactgctgacttgccattcttggagcccactttctgttcttgtcagccaattccctttcaggtgctcaggtttccctccctcctgtcaccgggcctttgcacatgctctacccaccctgcctagtggagagctatctttggcccctggacttcattcacttcggaccttctttgggtcacatttcagtcatgcctcactagacacctggaatctctgcctcactagacacactagcactcactcttttgggtcttctggctgtatgtaattgttatcagggcagtaattttgcatttatacaggtgctgaggtcagtgtctggcctttggctacttgccttgtgagccacctttgctttccagtgtacccctagctcctggcccagtgtccagcttcccagcatccattcatgttttccctggagaccattctgtgcccagcagccagagacatcattgcaacttaaatctcattgagtcgttccagttgctgtaagaaatgtaaccgtactgggtaacactatgcctgtctgtctccaccaccagatcttatacttcctccctcatctgctactccctaagctcactggccctttgttgtttttgctgaacgtgctaatctcttcctcacacctgggcctttgcacttgctcttacccctgcctcagccatccatgcactctcttggttttgccgtgcccgacttcagcatttttagttcacatggctcttccgtggggcccttccctgaccaccctgtttgaaatgctacccatccctggcacacatctatcatagtcattcattagcaattagccccatctcctttccctatagtacttttccataattttttttcttgctcatattacacctccccaactaatagatagattccaagaaattgagtgctttatcttcactacctggaatagtactggcacttggtaaagcacagcgaatattgttgattgaattactaggggttggcttagagaggtacttaatggaatgattcaatggatgaatgaatgaatgcattgccacttttttgctcattatcatcaatttgtacatatgcctttcaactcaaatatttatccattggctaaagaaaaaaaatacctgaatccccgtgtctctgcagtttacccttcctcactgttaaaactcagtgcctgtgtaaaatttcattatattttatttacttcttattccacttgtgcattatgtggatattcctgcctcatccccacagccacctatcacttccggccaactcagatgcctctggctcgcaacaatcacttctctgttgaatttctgaagcgtttaatctgcagtatgtctgttactcatacagcagttagtgtgaattgtctcactcagaataagtattcattaaatgtgtaagaatgatgatatagcctaatttcagatcaagattgtgatttatagctcattcttaatcagctgtgtcatgactttatttatttattccttttttttttttttttgagacagagtctcactctgtcacccaggctggagtgcaatgcagcttctgcctcctgagttcaagtgattctcatgcctcagcctcccaagtagctgggattacaggcgtgcacccccacgtccagctaattttttgtatttttagtagagacggaatttcactatgttggccaggctggtctcgaactcctggccccaagtgatctgcctgcctcggccccgcaacgtgctgggattacaggcatgagccacctcctcaggcctgagtcatgaatttttggtagtccagtcatgtggttatcttcctaaagctggaggccttaaacctagggccccaggtgggcttatgcctttagctgcaagtaacaagaaacccttttcaacctttttactgatttatttagagagaagtacacataagaggtaatgcaagtaagcaaagttttttaagaccacacaactagatagccagcatccggaccagaacacagagacttgctggcccctagaatcctctctcctggcccctgccagttactggcctttcccctgagttctatttgcctgcagtttgcttgttttcatatttaattcaaatagaattaggtgatgtgtccccttgtgtttcgcttctaacagtgcctttatgcgggagaagtactggctatttcttactttgccctccctccccggaaacattttcctaatttagtagcagtaatttcaaaaactgctttcctttcggacaaactgacttatccagccattgtaccttccagtttagactctggcagtttggagagttgagacagagagaaggagaaccgtctgtttatcttcttgaaaaaaactactgtattttctctctcttctgactctgggagcctctagactcttttttcccattttcatatccacagaggaagagtctgaacctcttcctgctgagctttcccctggttggttgcatttcaggaactgacattggttgtcttccctcttccctcatcagtgcaagtaggttggatctcatgatagtccatattcacataaccatgagaatcagagctttctctctgtcatttcctccctgtttatctgtagcaagaagaaaaaagtccgtcttaacagagactgtgaaagaataaatatagactttattgttttagagcagttttaggttcacagcaaaattaggcagaaggtactgagattctcccatatactccctgttcatacacttgcacagcctctcccattatcagcgtcccccttagagcgatttgttacaatcagtgaacctacactgacaccattattatcacccaaagtccatagtttacattagcattctctcagcattgtttattctgtgagtttggaaaactgtctaatgacatgtacccaccattgtagtgtcatactgagtacttttactatcccccaaatcctctgtgttcctcctgttcgaccctctcttgcctttaacctttccaagccactgatctgttactgtctataattttgccatttctagaatgtcatatggctttcttagaaaatacaaatggtgacttttttggcatgactttaataaacagaaatgaaaattggtgtgtgaatcaaaatctttcactctgtaaagggacttatcaggcggcacctgcatgtggaattatatcaaggtcagctttagttagaaacagaaggagagtcacctttgtgatgtcatttctccttcatccaagtaaaatctcgcatgctgacacataaaattttatcatcagtgatttatttcctcgtaggaatgtccctttgaccttattaaattcagatactctggggatggtcagcattttcagatggttcccttgttctgtaaaaatgtttgttattggtgtttaaaagctgtaaaagccacccactataaattgatagccactaaagtctgcgaatgtggtatgaatgttccactatgttgccaagcgtttattttattgtgagttgttatttgattgtttgtaaggaaattgttttatgatgctcagctttatatttccataaactgttcctcccttgcaactccttaaactgtgatgagcttttcaaaacaagtccacaggacaacagtctgtccagcatttgaagaagtggtggaaaagtcatttttttcctttcagtgtttctagctgttcatgaaaactgcagttaaaagttgtaatgttgttgtgtttggcattctttgggaagatgcagcattattcaaacaaaaccgtgtgctcttgttttaaatagtgtccaaatgaataattgaattcatggacatctaaatttaattccagaaatcaaagctatggtaataagaacttggacctgagttctcttaggccaagtaatttaattccttagccggttgaactatttattacgtgtctccgttcctggttattatgccagtaaattgctcaggcagatgcagggatggatgatgggcatataattcactctttttcacggctagacacataccagaatgcagatcacactaaacagctgtttttacaaacatggtttctattcagagctttaagggccacatccaagtaataacaaagaagcctggagaaggaacctggggatacccagggtcatgttttcaccatcccacctggaaacacggtgctgtccaaaccctggatggtacacttggacatcgtcattccagtcatggttcaagatcacgtgtatacatcatgatttaaagagaatactggtttgatttttcttcctgactttccctgaattttccacttaaattggaaaacagcgctagttagtgcccatgatttgattgaataagtaagagatctcaaacacggtaaattaactgatgacatgcatcaggtcatctttctttgattcaccagtaatacaacagtgagatcctacagaaaaatgcaaaggcagaagctcagggcagctgagcaactgttaaggattcttttgaaatgtagccccacgtagtaaactttcgtgcaataatttgggcagtcaaaaaaaaaagtcagttatttcacctcatttatttctacgaggagataaaggcttccaacatctgattttcagtgccagtgttttctgtttctcttttcacctatttcgtcctagtcttgtggaaatgttacaataactgattaggattttctctgtattaacacttcatttattaacatatgagtaagttgctattaataaattattctgcttaatcagtttctttttattctttagccacatgctaaacttcttcggatgtcttcacttaatatccttacatcatatttaatcagagttagaaaggcgttccacttgggggtcatacacatttttttgaaacttttataaacgccctttatactattcttgtatcctacgtaatcagagtcaggtgttccatggggatcatacacatctttatacaacttgtgtaacacatgctttaaatcctgaggtaatcagagaattcctgccattgatggattaatctctttacatatctttccctttcactctcagcaaaactacttatggcggtcctgttagactttgaaagcctttcaggtttatggaggagtcttcctttctattgtcgtagatcatggaatcatagtgttcgcttgtctcacgtgtttggaatctgatttcctacataatgctgtgctctcactacgagtccaaggcttcctgtggctacaaatcccgggttcctatcacttttcccaatgatgagcttctccttgttggccagaatcagctctgtggtaataattcccttctgctttctccctctcgcttttttttttccttctgggtacattataatgtcagcatagcagcttttaattctattactatggtacttctcgaatagacctgtggtagttgccccagaaaggttgaaaccccctgccacatctaggtctttctcctgtattggttttgtgatctgatcaaggacatctattcctctagtcctgctaggtggtatacgataggcttttactattagatattcaaatgctgtcaaccatgcctgccttgacaggtacatgatttccacaaggatttcctaataggcctttttaattttgttctagacatgcccttcttttgccatccaaatttgcttattttttacaaactatgatgcatcagcatgtaaatgtttaataccataaatatttctgatcctcttcccaatttcactgagttactggttatctcttgccattattctcagcatattgcagtggatctcagaatattttcccctgaccaccagcatcagtattacctgggaatttgaaatgcacattctcaggccccaccaaggcctcatgattcagaaactctggagctgcattagaaactgccacaggcacctggtgatctgtgttggtttttgtttgtttttaaggagacagtgtctttgtctccctggctggaatgcagtgatgcagtcatagctcacagcagcctcgaactcctgggctcaagcaatcctcccgccccagccttctgagtagctggaactacaggtgcacaccaccatgcctggctggtttttgtttgtttttaaggaggcagtgtctttgtctccctagctggaatgcagtgatgcagtcatagctcacagcagcctcgaactcctgggctcaagcaatcctcccgccccagccttctgagtagctggaactacaggtgcacaccaccatgcctggcttttttttttttttttttttaatttttttggagacagggtctcaccgtgtggcccaggctggtctcaaactcctggcctctaggttttttcccacctcagccttccacagtgctgggattacaggcatgagccaccacatttagcaggtaggtgatctgtgtttcaataagccttccaggtgattctgatgctcactgaaatttgagaaccactgaaatatttggttttctacaaaacataagcagttagtaaccatagggtacgcaactaaatagttccagcaggcatccctgaccacagggcattgcagatttacttaagtcagtttcatcttccacctgtgtgagttccagcaggcatccctgaccacagggcattgcaggtttacttaagtcagtttcatcttccacctgtgtgagttccagcaggcatccctgaccacagggcattgcaggtttacttaagtcagtttcatcttccacctgtgtgagttccagcaggcatccctgaccacagggcattgcaggtttacttaagtcagcttcatcttccacctgtgtgtccagtttaagctctcagttgcagtttttaaaccaatttccaccagcatatactgagtatccgctaccgtgcaatgcgttgcggctcttgtatgtgcactatgagaagtaattcccataatacggcaaactcagttttgatatccaccaccccactttttataatggactacatttttcagagcagttttaggtttacaaagaattcaagcagaaactacaaaaagttccctctacctctcacttccccactccccaacagtttcccctggattaacattttgccttagtatggtacgtttgaaccaatatcgatacactattattaaccagtattcctgttttaacatgagaggcgactttttgtgtagtatagtctcttggttttgacaaatgcttaatgctgtgtatctattattacttatgacagtatcgtgcagagtagtttctaaaaatcctctctactccacctattcatcccttccccactccccctgaaccactggcaaccgctgatctttttattgtctccgtaattttcccttttccagaatgtcctgtggttagactcatggcatccccttttagcaactgcagaaactaagaactgtccccaaggataaaaatttttgcagacccactgagctgggatttatacttagacctgctgaattgaagttttgggtgtgtttcttctcaaattgccaaaattccatatggacgacttttcttttccttccctgaaatgtgtttaattgactttttctgttatttgtgtttgccttcacagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgaggtaatccaccatttgcttggattccccccacccccaaggaaaagaaagcgtaataccagagttggaaatatccaccctagcaccactgccttccccaatcaaaaacatgtttttttttccaaaaggcttcttatgcttgtgaaatttttttggtttaacaagcaaacaatttcaaataatgtgaaatctttattatacagtttgttttgtaccttgtatatgctgcttggcaaatcccaagttaattctacaagactccgcccaaccaggtagtcatctaatttgacaaacactgagttaggtgactccttggtattcctttggcagtgagtgtttgttatataatattgtctgttaccacctagacgatgagctccttgagggtaaggacttgattttattcagtattgcacagagtgcctggcttgtagtttcgataaatcttagttgagtgagtagttgtgattagatttcattaaagaaggagatttgggccaggcacagtgcctcacacctgtaatcccagcactttgggaggccgaggcaggcggatcacctgaggccaggagttcaagaccagtctggccaacatggtgaaaacccatctctactaaaaatacaaaaatgagccaggcgtggtggcacgcacctgtaatcccagctatttgggaggctgagacaggagaattgcttgaacccaggaggcggaggttgcagtgagctgagatcacaccattgcactccagcctgggtgacagagcaagattgtctcaaaaaaaaaaaaaaaaaaaaagatttggtgagtatcgcattattttatgctatgaattttaacagaggtgatttatgttgagtttacattgttttattgggaagtacggcagtgctttcttcaagaagtaaatatagtattaatgtcttagactttctctattgaattaatgtttgtgttgcaaatattgtgaactaaaagaactaaaggtcatacttgtctccatgaaataaaaacaaacattcagttgatattaaatgaccaaatgttacagaaacgagtaaactgttggattgagttccttaaagagtatgcatttgttccttaaagagttctgcatttcatatctgccatctgcttggcagatagtaaaagatgcttctagagctagattgaatgaatatgtacttactgaattttaatgtactgcaaatacttataaaggtcaaccacaaatgttacagcatttacaaaaagtggctttctctcactttttgctaaagtttaatgatttcagatttattgttctattagagcttaacatgggctattttgtctccctcaactatattcatagttgtcactatagtattttcttccctttgttgcattttttaccttattaaggtgtaatttacatataagtttcatttgcttttaagtatataattcagcggctttaagaaatttgccaagctgtgcaactatcaccataatctaatcttagaacattttcgtcactccagtaagatcacacatactcactcccagttaagccctctactcacctctagccccaagcaacaactaatctactttctgtctctatagatttgcccttttttggactgttattataagtgggatcatataatacatggtcttttgtgtccgacttctttcacttaacacagtatttttgaggttctacatttctttaacttgagcttttaaaattgagattattctgaattaaacactcagcgttagcttaaaatttattgaaagttttacatgttctttgaaaaaaaagaacagagtgcaagatggattaagtttatcattccctacttaatgacagtttcttactcactttagcacataagtaaatgtgctagtaaatgcgcattttgtttaaaccaccatttttcaaatactgagacatgctttctcagggtgtttttcatacaactgttaggaccaactatggcagatctggtcaaatgaacttgttagcctgatgcctgtagcagggaaggacagcttttcagggcttctcttctcgaaacctaaatgaagtgtgaatacaaattacagcagctagcagcctgcagtgggactgaaagtccttggtgaatctccatcaagctgggctgtttaatagaaccagtttagtgtcccattttacttgaaacattagattttgagcacctgcttggtacaagccattttgctaggccatgtggaatggatgatgagcacacacagaccagctaaccctagtggatgttaaaatctcttaggaaatagaagtcaaagaagtacaaagccatctgtgttgtaagaaatgtgaacacagaacctgcctccgagagtaagagggaacttctggattgatcagagaaggttccatggagagcatgacatttgaactagagccaaaagtgtgggtgggtggtgtgtctaccagtggattttgctgtagagtcatcaggactagcaaaacaaatgtggtgccatggaaaggcatatttaggagacaggattggtccaatttaagctagagcagatgtcttttaggttgggaccaaaatatagagaccttcaatgccaggctggcaaagatgggcattaactgcaggtgattaattaacaaatattaattcagaagctactgtgcgctgcagatttttccaggagacaataaagagattttgttttgatgctagtactgttgaggtaacaggtgaacaaggagtgacatcagttatgcagtacaatgagaggatgccacataaacttaggcccatattctagaacaagacaatttgcttgagataaattggtctcattatcgtctgcattagtccagttctttttgcttgagttttgcaggtagtattatttgatattaagacggaacacagagatgttgtattgttttatttcctgtagaaagacgaaggcagttaaaagaatttcataaacaaaacactccaggctaaaggcaaaaaagaaatgaaccttaaaaaataacaagttaataattttgttggcaagaagagcaacaaaagcaaccttctgaaagcaagatacctggtcattgagagatagcaactgttaatgccccagaaatagaggaatctttaatgcaggtccattcattccacctcaaactcctgaacaaaagctctaattgaggcaagtcttcctgggaaagggggcctaacagaaacatgttatggtcagttgtgcccatgcgagataatttttttgtgcttgtagctaattccagtaaagaagtagatgttttagagggtaacgttaaaggggtcagctgcaaagagtccttttcctcctcctcactgttacaaaaggtgacttgtggttcttccctaattgagagcaatggcaacgccataggtgattactcattttgtaaaactctaattacaagtaggttgcttctgtgttcaacataaaaattagaagtgacttgcaaagatgagatactgcagggaggcttacaatcttgttttcagtgttagtgtttcagtacctggaacaaaatgtgatttacagccatcctttctaagaaaattgtcatcattaccaacatattgctactgataccagtccttaatgtgcttcataaaaaactcaataatttcataacccgttaaaaccggaaagaaatggagggaagaaaaataagacacttttagcgtagtcataatcttctctgccatattgtgttagaatcgatgatacccaaatgagaagatgtctgttctctgtcactgattccagtagaataaaattattgtttaaaagtaagcacatccgctgcactccagcctgggcaacagagtgggaccctgtctcaaaaaaataaaaataaaagtgagcacacgattgcaagatctatctggttttgggggcttattgtcatctttggttgttaaaaaaatacttggatattattggttattggtctagtggaataagccattaccgatttgagtacaacagtggtgtatttagatacttgctcctaattttctgttcttcaagaagggattgtacttcagaaaccagagatatcagggtagttttgattgagccataaattctaaattctgattgaaatgggtattgtaataaatggcataatcttttatttaatctagccaattgtgccctgtccagaggaactggacatttcttccttatgttccatttattcagcaactattcgttgtacccctgctgatggctaggctctttgctactgtggaaggcatcgttggggcagagcagacagcattttacctcctgggagactggcagatttttgaagcctttgttgcagatatagattttcacggtcaccactcttgccctttaatgtaatttaaatttttttttttttttttttgacacgggattttgctatgtttcctaggctggattcaaactcctgagttcaaacctcagcctcccaagtagccgggaaaacaggcctcttgtgctttaaagcagtgattctctgtctttaaaccttgtaactatgctgtgtggtggaaattttacttccccgtttaaagccaagatctctaaggccaagaattttttttttttttttttttgagatacagtctcgctctgtcacccaggctggagtgtagtggtgcgatcttggctcactgcaagctcggcctcccgggttcacaccattctcccgcttcagcctcccgagtagctgggactacaggtgcctgccacgatgcccggctaatttttttgtatttttagtagagtcagggtttcaccatgttagccaggatggtctcgatttcctgacctcatgatctgcccaccttggcggcaccccccgccccccgccccccgccccccacaaagtgctgggaatacaggccaccatgcgtggccgaaaaaaatttttttaattggcctgggctgggcgcaatggctcatgcctataatcccagcaccttgggaggccgaggcaggcggataacgaggtcaggagattaaggccatcctggctaacacggtgaaaccccatctgtactaaagatacaaaaattagccaggtgtggtggcatgcgcctgtaatcctagctacacaggaggctgaggcaggagaatcgcttgaacctaggaggcggaggttgcagtgagctgagattgtgccactgcactccagcctgggcaacagagcgaaacttcgtctcaaaaaaagaataaaataaattgtcctgggtcacataactggttaagtgatgaaatcagaatttggacctagataggccaggatatttctgctacactcatgtcaaaattacactttttattttctttataaatacacacaaattcatttcaacctgtgttcccttgtaaatgcatatacctttgatataggcatatattcatctattattttacactgtgcatttctgaatttttagaatttttacttgaagtgatcaggctggcgctgtggctcacgcctgtaatcccagcactttgggaggctgaggtgagcagatcacctgaggtcaggagttagagaccagcctggccaacatggtgaaaccccgtcttcactaaaaatacaaaaaaattagctaggcatggtggcgcgtgcccataatcccagctactcaggtggccaaggcaggggaattgcttggacctgggatgcggaggttgcagtgagctgagattgcgccactgcactccagcctggcgacaagagcgagactccgtctcaaaaaaaaaaaatagaaaaatgatcgggggtccacaaataagagtaatgatcaagggtcagcaaattggggccaaaaatagcctgttttcctgttttctacacaaaagttttattaggcacagcccatcccatttgtttaaaaattgtctatggatgttttcatgttttggaagtagagttgaggatcgcaaaagagattgtgttgcctgcaaaactgaaaacatttactatctggccttttcagtaaaccatttgctaacccctgattctcactataagacggtgactgtgaagttctttctatttcacatactgccatatcaagttgatttcttttgaggtagggtttgtttttttttggttagagatagactagtatagtgtttgagagaatttttatgaccttgggccagttaagtaacctgttttttatgtgtgtagtgtagatggtaatgttatcttgcatgtttcttgtaagaatgactttaggtaacttatgttaaacgcttaccatcatgcccagtaagtgttcaatttacaaactcaagctgtccagattcaaatctttgccttacaagctactaactgtgtaaatttgtataaatcaaataaccttgaatcctcattgcttctttttgtaaaatagggattaataagacctatccaatatttaactattttgtgaggattaaattaattaatttataggaaacactttgcataattcctggtatacagtaactgctcaattaaccttagttgctctcttagttatggttatatcatcattccgatcctccattgcatttgaaacattagcaaactaatgtttactactaatgaggaatgttaaaggtaaaccaataagttgacttttaattataaaaggcataaatgtaacctatccatatctattggtataataaagctgatatttagagagaacattatgttatgattaaaagaaacatttcttgcttaaattttttttgtgtgaatatacactgtatattgaaatatctgcacttaaattttaaatccagctgaaaattggataagatagtattagatgccactgcatttcaagatagagttttatttcttgcaggtattttaagccttgtgggagttcttctgttaagtgaacagatagagacactgatacagatggctctttcaccgtctcatgtgatgataaaagctaaaaggtttgatccgaatattgcttatattgggctaagtgattgaccttggcagaattaaattatttttcttcttctggtgacaattaatctgggagaagtaccatttgatttattgctatacatttcaccaatatccacaaggcacttgtaggtaccagacatggcattggttgctgggggcacagagataggaacaaagtggcttgctcaggttgcttctagccatatctgcattgtccttgagagggatgagtctctcaggcctgcctaggaaggaattttggcagcatggagaagagaaagtgctcagcccggaacaaaagttttcacctactatgttgcagagaagttggcgtatcagtaattataaaggaagaatagggatttactgggtgatagagcaccaaatagaatgaatgcaatacatacttgaagtaaatcagagtagcttgtattgatctcaaggggagaagaaacaaagcttagcttaattctcatgcctctgttgttacttgtttgtaatggacatgacacttacaaggtatcctataattcactaacgggatttttacttatgattaatatttaactctccacaaagcttggggtaaactgtgaacttaacttgctgtgaacccgaacatgaactcacatacttcagttggaggcctcagtagtagcatgctgtacaaaaatgaaactaaagctccagggagtatttgggaacagggcaaaagggtaatggctcctccttatagagcaagcctcaggcctttacctttgtgttttgaagatggagaggatgcacttctactctcgcccgggttgtagcatgcttgctaatgatgtcaagagaactagtgtcagcactgaccatagatgtgacaggtaacagcctgttattttgtgccccatgtcatggcagccattgattccgaggtgtttgatacacactttgatagaggcagagtgaagcaggacatggacaagcatctttccgtgtagtttaatggtctcaatctagaaagcccactcagataattaggttgcttaaaatgtgatgagactagggaatagagccatatagaagtgtgtgtgagagagaattcagtggtttagtatattcacaaagatacacatttgacaccagcctgggcaacatagtgagaacctggctttaccaattaaaaaaaaatagaatagcagaagtaatcagtgaaaggcattttaatacaattatatctagatttattaaaaataaaattttagtccaatttaattaaaggccagaaactagatttttaaagaatattagtctttctcatattttccccaaatcagttgctttaaaaaaaaaaaagtgtgcagatgcctcaggcacaataactgtactcaactcaagaatttgcaattaagaaaaaaaaaaatcaaacctcaaagaagaaatccagcaactcagaggttcaggttcatttaaacatgcatacatttacatgggcacactttttttgttttgttttgtttttaagatggagtttttgtttgtcgcccaggctggagtgcaatggcgcgatctcggctcactgcaacctctgcctcccgggttcaagtgagtctcctctctcagcctcctgagtagctgggattacaggcgcacacaaccgcgcctggctaactgttgtatttttagtagagacaggttttcaccatgttggccaggctggtcttgaactcctgacctcaggtgatccacctgccttggcctcctaaagtgctagcattacaggtgtgagccactgcaccagctgggtgcacctttttgtttgtttgttttgttttgttttgttttgttttgttttgttttgttgacatggagtctcagtcacccaggctgggattcagtggcacgatcttggctcactgcaacctccgtctcccaggttcaagcaattctcaattctcctgcctcagcttcccaagtagctgggactacaggtgtgtgcaaccacacctggctaatttttgtatttttggtagagatgggtttcaccacgttggccagactggtctcgaacttctgacctcaggtgattcacccaccttggcctcccaaagtgctgggttactggtttgagccaccacacccaaccgggcacacgtttttagccaagccataggtctgattaagtacagtcagattccttgagcaggttacaaagctgtggatttgaatggagatctttagttcccttgcagaacaatgagtttccaaaagcagagtggcttacagcctaaccagctgcttctctcagcctttaaccattttgccctcctgaaaattcatctttggtttccaaccacctcttccaatatgcctgactttttgtgattctgttagtagaagagtaaaaagtcaaggggaggcaagaatgaatgaatctcatataaaaatgatgctcaagagaatcccttaattttcaagacagcagcccaaattgtaaacattgagacttttacagtgttaaaaaaaaaaaagtgtttacaggccaggcatggtatctcacacctgttatcccagcactttgggaagctgaggcaggatgatcgcctgaccccaggagtttgcaagcagcctgggccccatagggagaccaaaaaaaaaaattgttgttttggctgtagtgtcacaggcttatagtcccagctactcaggaggctgaggtgggagggtcgctggagcccaggtgaggtcaagcctgcagtgagccgtgatcacaccaccacactccagccttggtgacagtgagaccctgtccaaaaaaaaaaaagattaaggcagaggaaatgttaaaggttacgctatatttagttgataataatggtaagactgttcaggtgttttaactatgagagtagggttgcctctttcttaaatttatatatgttcttattgggtataatttctagacagaatatgcaagtatcacagaatatggatggcaattttatgttgcttgcacgtgactttaggttcttatgtttcatgataggagcaaagaaaagtcttgcttgccaattcttatgattgcatctgttctggaaatttactagcatttgttacccaggatttctgaagtgctggtgactgctgcccagtagtcttggtgggcaaagttactaaaatgcatcacgaatccttctggtgtttgcttgggctatggcagggtttctggaccttagtactattgatgttttgggccagataattgttgcggatgattgtcctgtgcattgtaggatgtttagctgcatcactagcctctactcgatgccagcagcacccccaagtgatgacaatcaaaaatgtcccctgggaggagtaggggatagactctctctggttgcaaaacactgggctatggtgttgagatctgcagtgatgagcagctttagatatgtgaacagaagcccaggcgtggtggctcacacttgtaaccccagcactttgggaggctgaggtgggcggattacttgagatcaggagtttgaggccaacctggccaacatggtgaaaccccgtctctactaaaaatataaaaattagccgggcatgatgatgggtgcctataatcccagctacttgggaggctgaggcaaagaaatcacttgaacctgggaggttgaggttgcagtgagctgagatcgtgccattgcactccagtctcggcagacagactgagatgccgtctcaaaaataaataaataaaaataaaaaagtgaacagagaaatacccgtgcaatactgtgtctcatcccccaaagacggagtcttgctgtcgcccaggctggagtgcagtgacacgatctcagttcactgcaatctctgcctccatggttcaagcgattcacctgcctctgtctccgagtacctgggattacaggtgtgcctcaccaagaccagctaagttttgtgtgttttttttgttttgttgttttttgcttttttttttttttttttttttgagacgaagtctcactctgtcacccaggctggaaggcagtggcacagtcttggctcactgcaacctctgctgcccaggttcaagcgattctcttgcctcagcctcccaagtagctgggattacaggcacctgccactgcgcccggctaatatattttttttttttgtagttttagtagagacagggtttcaccatgttagccaggctgatcttgaactgctgacctcaagtgatccatccatctcggcctcccaaagtgctgggtttacaggcatgagccaccaagcccggctggtctcattttaatgtaagctctaacttctgtatcactgctttgcacattgtagataaccagtgaacattttttattgtataagaaaaagtaaaataaacaaaaatatgccaaagcaaatatgataaatacacatttagtaaggtaaaagcaagtatttgataaaatgtgtaatgtagtctagtagctttatttagaaacagaaaacaacataaaatgttgacttgaaacattgcgtatgcatatttgccatgtagacagtgagatatggaggtaaactgctttcctagttttgttttgtttttttttttttttgttcaaaaggaattcactctccccttgtccactgttataaaatagcaaatggtgattagcatctgtgctgtaaccagagacactgctgttcccagctggaatctgtaggttctttgcctgctagagattgtgacaagaagccagttaacatggagaggtgtacatgtcagtcttccccagaaaaggacatgaaacagtaggaccatccttccaacccatgacctacatctagaggcattctttttttctttttttttttttaaaccggaacagaaatatcatctaattctttctttacagagaagtggtataaggaagtacattctggccaggcacgatggctcatgctgtaatcccagcactttgggaggccgaggtgggtgcatcacctgaggtcaggagtttgagaccagcctggccaacatggtgaaacccctcgctactaaaaatacaaaaattagccgggcgtggtggcacacacctgtggtcccagctactcgggaggctgaagcaggagaatcgcttgaacccgggagacggaggttgcagtaagccgagttcactccattgtactctagcctgggtgacagagcgagattcgtctcaaaaaaaaaaaaagaaaagaaaagaaaaaggaagtatattctaagcccttgaattgatcttggctttcttcattatttttacaagtaaaaataaaaactttgatatttctgatgttctgggatattataggaatgataccacttgaattcagctttctaagaagtctggtatttcaatagtcttaatatgagtaagaaaattatgatcttggtactggatctaaggcagaggtatcgaagctgttttaatgttgcttgagataggacagaacttcagagtaaaataaatgtgtatagacaatctgttcaatctgttcaaattaagttgttgagctgtatatttgaatcttaagactactaattttgttgtatctgtcttttcccaaatatatgtgtacttcttttaataagccaaaacctatgcaacttttactaattcttccctaactacttcttttggaaaatgattaaatcttatgtctcacgttttgacatatctattgcatttaaaagataaggttgatcatgctgcttctcaaactgagatatccattcgagttatccaaggcccttggaaaacaatcgttgttgagtctgtatggggggcctgagtcccaggtggtgttgactctgctggtccatgatcctattttgagtagtagactctagtagcgtctcctgccttccatatggtgcagatttgcagcattgagacaggaagtaagaaactgaaaaggaaaaccattcttacctttggtgttattgttcttggtatattacagataccaacaagtatgaggcaatcctgagacatctacctactgagcttttctttccttaaattcacacctcaagaccaaggaaaccgaaaaactcttacagtctccctacatgtgttcacttgtgcccctatttcctgtcattaacatggtagtgtagccaactcctgctagcctgtaaaagctaattattacagtatagaggaattttgtaagccatagccattagtagcttgaaataccaatggtgggagtatttataccatggcagttggcatacactgtaactcaagagtgttctatttgtttgtttttctagacagtgccagtttcccagcatactcctgtctctcattcagtaagaaaaagcacttccccttattttccaatacaggacatgatatcccgagttttgagcttcttgttaatagcctgttgcacgctaaccacgcagctcagtgaagagcaagtttattcccataacaaacaggaaacaaaggttgaggaaaaaccacagtggtacccttttgtgagtgttccctaacaccgtcacgggagtcctgattagtctaaatactttacaagtaaatctccttcaggtggcattttataaacaatctttcatcatggagagatgagaattgggtcaggtataattagaatgacagatgtattggctagcctgagagaattaacgcaattcagtaaaaaggctagccaactgcggatatcttctagttacttccgtgacaaattagcaccatcctcttgtactgaagcagtgctttcattagcatgcacagctgtttgcatcatctttgtttgtatttcaatccatatttggagcttaagtgagatttgtcataagacttcagttcaagcttgcttgcctaattttacatgcttctatttagtaaaatatgattactaggtcataaatatttgataatttattgccttattagagtaattttctaaacatgttttttgacgactgcttgccactacgtacaagcacttgaaaaatgttcttttctattaaaagtacatggttccagaattgggaaaatcacgttcttaaaaaataaccagttttctattgtgttggcttttaaaattttttcatcagtagaatcaaatgcaaatattgtctgcttatttttcaacagaatacaagtttgattttaataacttaggctcatgaaatgtcaccacgtagtaatacttagaattacagcaataacttaggctaaaaaaataaagttgttatgaactacattgagctcagacagatatatgtattatgtaaacatttatataaaatgtatataaattgtatattgtattatataattatatattgtaatatatagtatataatatataatttataaatataatacataaattatatttataaattataaagtttttatataatatattataatctaatatattataattatatttataaattataacgtttatttgaaatattgaagttttgtatacttagtggattttaatatttatgtcgttttcattttattccactgttacattaaggaagtaacttattacaaaaataaattatatttgtcttacatttgccctttttactctacttaaaattggagaaaaagagttcaagatagggaatttctgtcagaaaggagaaatagttgtattatgtgaagtttaagtagatattcttgtagagtatggagaaaataatgctataaaatgttgccttttaaaaaaaagttcagaaaatatagttcctagctctctctaaatgactagtttgattgtgactgctttcccaaaatttgtaaatttaaaatttatacatcacatggaatatagttttatttcacatacattccagtaggctgagaatacttgaaattcaatgattaaaaatgaaataataataaccagctttgctttattctaaaaccagctttattctttatttaccactttatttacagcgaattatttgctaatctgttaactttgcttcataagaaggcattataattatcgtacatttgaaagtggagattttctccccattctggttgccagtttcacaactgtgttcattctaaatttattaaaatatgtaaaatcagctttctaaccttggttgtccacaaagaatttcactccaatttgaaatatctattcagaactaattttttgtggttgagcattattttttgaacaatgaattgcataatcattttgtataatccagggagctctggcttagattctgtattattttgtgttatactgatttttagaaaatggaatgtagcgttgacacgagcacaaatctcagcaagggcctaccttacaaagataaaatgcgtggagttttattagaagcacatgattttgctttgtgtttcgtatacaccagcatttcagtgtagtaaatggcattttgtcttgaagagtgagcagagttgttacaaaagaaggcataatgcttccttgccagcagaattcagataagtgaatatcagaaaagctatttgtgatcttgaaagtgtaagaaattcaacatcaataaaggattgtggttccttagatagccatgtaagtctttgcctatgtttctaacatttctctttaggaaatattcttgcttttatttttctgaacaaattttctccattattatctctgatatttactttgaacagaaaggtggattggaaatcaaaaaataagtttgatttcaaaaatgatttcaaaatgttagttttctcagtattttacattttgagaagagaacaaagaaggcagatgaagagttttttgttttttcttaaatttgttttcttttcaactttatttttaattgacataataattacatatagtatacattttgaagatacggttttaattttcacaggaatcttatttgggtttagttatataaggtctaattttgcatcctctacatttagtggctgatttataaatttccactgagtgataatagtaattaatgtgaaacaggttttttgctgatgtttttagaagtttcagtagattaggaaggaagaaattatgctattgagaaaaatagaaaatgtaaacataagcatttgaactctctcttgagatatttttatcttccatgaaactagatgcggcttattgaagatgtgtttcaggtctcagtgctctaaaactcttctacttggtgagcatcttgattggttagatctcttactaatatcccattgctagagagggatgtaaaggaaattttctcaaactgagatttccaaatcttccaatctctgagtcaagtaaagagacaaggttagaactcttaggcaaactgaaaaatcaatattcctatattatcattatttttttctttttttgacaccaagtctcactctgtcgcccaggctggagtgcagtggcactattttggctcactgcaatgtacgcttcccaggttcaagtgattccagtgcttcggcctcgcgagtaggtgagattatatgtgcacgccaccatgcccagctaatttttgtatttttagtagagacagggtttcgccatgttgactacgttggtcttgaactcctgacctcaggtgatctgcccacctcggcctcccaaagtgctgggattacaggcttgagccaccatgcctggcttcctatattcatttttttatgtgggctttttaaaatcttttcaatagcaaagacttgacaccaacccaaatgtccatcaatgatagactggattaagaaaatgtggcacatatacaccatgaaatactatgcagccataaaaaaggatgagttcacgtcctttgtagggacatggatgaagctggaaaccatcattctcagcagactatcacaaggacagaaaaccaaactctgcatgttctcactcataggtggaaattgaacaatgagaacacttggacacagggcggggaacatcacacaccagggcctgttgggggggtggggggttgggggagggaaagcatcaggagaaatacctaatgtaaatgacgagtttatgggtgcagcaaacaacatggcacatgtatacctatgtaacaaacctgcacgttgtgcacatgtaccctagaacttaaagtataataaaaaagaaaaaaaattaaaaatcttttctttgagacaattgtagatttacatgcagttgaaagaattaatagaggccgggcgcggtgcctcacgcctgtaatcccagcactttgggaggccaaggcaggcggatcatgaggtcaggagatcgagaccatcctggctaacacagagaaaccccgtgtctactaaaaaatcgaaaaaaattagccggtgtgtggcgggtgcttgtaatcccagctactcaggaggctgaggcaggagaatggcgtgaacctgggaggcggagcttggcgaagcctgcagtgagtggagatagtgccactgcattccagcctgggcaacagagcgagactctgtctcaaaaaaaaaaaaaaaaaaaaaaaaagaattaatacaaagagaccctgcatagtcttcactcagtacagtatcacaactattaaattgacattaatcccttaacactgctttaacccaagtctatgctgctgcttctccgtgttcacttctgagaggcactggccatttcttgtgtgcttattcatactttgtgtaaaagcattagcatcatacatcgctggtgctgaccctaccctcagtcccagcttctcccagagtaggctaagattctcttttctactacatggaaaattgttctggaataataaagggttagcaaaaaagtcagagaaaacaaacagttgcattccctttccctgtagtagagtaggaatataattatgagtgatagaggatacgttccattcctttcccagtcctctccgaagtcagcttcactgctgtaggaagttgctgttctcattatttccctgagggaaagtgttgggaagtgagagttgaggtgatggggaatcagggttgctgacaattgggggaattataacgagaagctctttttcaccaggagaggggttgcatgttaagagaaggcctatctgctcatcctccatgtcagcagatgagaaccagttggacaaggtagctgtctcttagagattgagaagtaacaaaagcacactgtcagtcctgttcttccagcctcacgtacatcttctccatacattatgtatttgacattaaattaacatacactgttacacccattcctgaccgcattatctcaggtagccttttgtatttgagtattgtgggatctgttgctattgcccatgatgcccacttggactccaccaaggcagtgaaactcttgggggccgttcaaagtcaagagtgccaactgcccctaacaggattgggagaaccaaccaacactccccgaatagggactaactcactcttttcttggcctttatgaaaggaaggagttaaggctcttacagctggagactccagcaagagttgtaggctcaacgtgtagcttatactatttacttaattaacatgtaaatggattttgagttctgaatgcttgttctagttgattagggctcatttagcctggcttctacgaattagctataacaaatggtttcatagctgttatagaatgaggcagaagaaaataaaatgaatgtagcattatgtttaattagtggtataggaaaatgttaatataatgccatttagattctggactggggagattgtgcctttatcataagtaagaaattgttgctaggtttcacataagggcacatagttatcatgaatcatctccttcgatcatcattcttttatcccattacttgacttgcacccatccaaaattctaccacttttatttaatatatagactcataaagacaaggtttgtgcatctgcagagctgtgatgttcactgcgaggcccgtggcacacatctataagaagacacatatttggtactctaagatgatacttttttttaatgccaaaatgtgagggtcagcataaattgccaaggcatggtaaattttgttgccaatgctcccgtgactatggggtgaagggattctgtgcctcccttggtagcaatgaccacggtgcttgcaatcccagtgccaattcccggcacagtgcaggctctggaggcactgctgccttgcagtcttattggaattaacactgcctgagtaagagattaataatgggtattgttgtgtcttagaaacgttaaagagcatgtgacatgaatatgtacacattggtgaaggagatacagagaaggaaagcaaagtgaagctgtagatgtttgttacaactgaaggtaagctctgggagcagagaccactgctggctatagttgatgggatccacaatgtcaatacaaatggggactaactattgttttacttccctatacacgttgctctttcagtagatgcaataaagtactggtaaaaccagaggtggctaccatcacgatgatgtcaacaggagggacagtcagcactaagcccagaaggtgtcaaacactccgcaggagaaatgcgccatgcaacggacatgaagatgatctgacactcttcacgtggttttcagatggaaacgtggctacgaaagcatcaacctcattatcatccatcattaaggccatctcactcagtactgctgctttcaaagtccacgctcccaaagcaaattggatttctgtacacaatactcttacaggatgaaacccaaccaacttgttgacgtaagtatcccatctacttcgcaattttatttatcttccaaaattaaaggactggcaccctgatttattaaaagtgaattgggtctagggaccatatcccctctgagttactgacagagcagcttctggcctgtgaagctcaaagccatgcctagatgtgatggatccttgtctttgattggctaattagaatcaatctgttgaaggaccagtggcagtggctcacgcctgtaatcccagcacttagagaggctgaggcaggtgtatcacttgaggccaggagttcaagaccagcctggcctacctggtgaaaccccatctctactaaaaataccaaaaaattagccaggcgtgctggtacaagggtaatcccagctacttgggaggctgaggcgcaagaatcacttgaactcaggaggtagaggttgcagtgagccaagattgtgccactgggcggcagtgcaagaccctgtctcataaaaagaaaaaaagaatctgttgaatattcctaacttggaagtaatgggtgatgcgtggctttcatcttttagaaaggtgttttttcctctgtcagtaaaactaagaagacatctgtgtgtgctaaggcgtcagtctagcaagggcagggcacaaacccagagagagaattgggctgttgtttcacttccaataaaaatgggatatacatgggaggtagagttataattctactcaggattgactttatacatgcaattggatgggtcactgattgactttgaggcaatcagggatgagtgaaactgatcttggggagggtggcaagacatgttgacaggtaagatgtgttttaatgtataacagtgcgtggtgtgtattaatcagttggagttgattgactgcgttttattgtttggaacattcctgcccaagggtcaggtaaatatacaaaatatacaaataatacagatttttaatacataaatatcaattaagtagcataattaaataatacattgttatagttgtacttaatgtgtatgtaaatatatacaaataatacagatttttaatatataaatatcaattaaatagcagaattaataatacgttgttatagatgtacttcatgcatatgtaattaaattattaatgtataatatataaatacatattttaatatacaaataaaatggtcttaaatcagagttaatttaagaccatttatattagtacatatcttaatatacaaatgaatggtcttaagttaatgtcattgagtataagtcacatttacagatatgacatgtgtttccagataaagtcaatggacagacagcttccaacactggaaaacattcaaaatatatgcaattaattttatatttgagttaaggcaatcatttattaaggaaagcaatcagatgtttgtgagggcttaaactttcgcttcataaccaaagcagtttccttacatgaaagttgacttcttaaaaagagaagtttattttttataatggagaattgttgtgatgtgcagataccttccgtcatttcatactcatctaaaagcagccaaatgatcttttcacctttggccggaatccttttattgctaccgagtcctgcactcattaaaccagatgacagtgcatgctctgagaggtgtaaatctctagtcctggtggccagttaaattcctcagtaaatgtttggtagatgctgcctaataaaccagtccaggttgccactgggaggattaaaagaagtaaacgtgtatacatgaacagagagacagtgccttttcatgctaaatgtggttccccacatctcctctgattagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccagtaagtggacccttcttcgagcctggccacctttcgtctctctcgccactgactctgctttttgtaacagattgattttcctggttcttgggaatgggcctgttgctaccactaaccacatttctgtccacttctctaattgctcagagtctccgcagtatgttcaatcatgagcacacctctccgtctttccctgataaagcatggccatggatgtgttctcttcctagctgtagcacatatgtcttgcaatccagagggacttttgagtgcttctcttttaaacaaagctggagtggctgttttgtcttctgcagccagccgtttctgcaaatgcatacttatgtgtttgtccgtgtacatatgtgttcatgtttatgcatgtgcactacctgtgcagatactgtctaccactggaagcctggctgatgcagcttgagttgcattgataaggtgtatggctgtgatgaatacctttaagttggttcataacatgtcttttattgtgctgatgagggaatgtgattgaattgagctcatgcatctcaaatgccggagggtagaagtgcccgtcttgccccctccgagctcagcacacagacatttgccaggtcaaacttctgcttcttctcttgaaagtagaagaaaacttttgacttaacgtgagaaactttcaatgacataaggctcgaggaacataattttattttttttgtttttttaaagacagggtctcattctgtctcacaggctggagtgcaatggcgtgatcttggctcactgcaacctccgcctcccgggttcaagtgattctcctgcctcagcctccccagcagctaggatcacaggcacatgccactgcgcccggctaattttttgtatttttggtagagacaaggcttcaccatgttgaccaggctggtctcgaactcctgacctcaagtgatccacctgccttggccatccaaagtgctgggattacaggcgtgagccactgcaccccgccagaacataattttcaaagtctttctcttgaacattaagcttttcataattccgggggataaaaatatgaagtcatgatgacttaagtgcatgatgaaattttccccaaagaggtaattctcaggaggtccagtaccagatgtgagacttccatgtcgttaacagacttccaagtgaaattcccaattgtgcttatttatttatttatttatttatttgttgttgttgttcatgagtaggaagtatgaactactcaagaagtaattattcagctcagcttgataactaaaaatgaaactcaataactgtgtattacttttttgagagactcctgcctaattctccgctgtgttgcaagggtggcagccacatttcctgcctgagattcctagggattatataaattgttttgcagcaagatcttaggattaagcaaaacaacagaagggcctgcaccattaatacccccactgtaaaggagcccaggatctaagaggaatgtaatggaaaagctcctgttggtctcctgccatcgccagtgaatgagatgactgcttcagtcccatgtgtgaacaggtgtaggaactgataacctcaagggctttttttttttttttttctggctctgattggatgattgcagcttctggctcaaaggactcccttcttcagtttcaaacaaagcagtcaattaggtcaggtattgcgaacacaatggagaattctgttgcctgcagcctttggaacaaaggccttttgttacagtgattctcactggtttagccggtgggagaggtttcctggcagatttgcaacttttttctccctttccctgggtggattcattttctgaaatatcatgtatagtttttggtaataagagatttatttggttttaattattagcagtgatgaatttgcttcaagagattaaaattctctccacctcaccccagtactgccatcccttcacctaacactctctccctttgatcagtttgggctgggagtgaccagtgggcacctgtccaggtgtcctgggtggcacacagtttgctgagggttttgcaaaaggtcgatgctcccaacagagatgtattagatgaggctagctatgcctgattttagaggggaaaggtgacagaataatgtatgaagaaggcaaaggctgaagatcagttagatgggtggacaagaataagtagagagtataagcctcagcaaacagccagagccgagagccacatgctgtcctatgaatgagtgaaataaatggagtttttgtgaaaaaatgcatcgaagggaattggggatatttggcacaaaaggagcaagaaatcctcttctgttaagaaacctgttgttactcggatatactatcagagacaaaatatccagcattctcaaatgttaacttcttacgaaaatagatcttatgtttatatgttcattttggttttgttggagggaccaaacctaagtgagtgattttgtttgttaggttgtttttttgtcagtggactcgtgcatttcagccatcattcccatgtttctctttttgtttttagttatgttctcttattttttccatagtgtcccaaagtttactcaagactacccaggaacctcttgcccgagatcctgttaaacgtacgttgtcattcacctgagggaagggaagaggggaggaggatgctgcttggttcacataactccagcatcatcaccttctttgcatggttttgtgtttcttgaacacctgtcttagtaaaatgtttcttcccattaccttgcttgtaattacatctgattttgccagacagcttgagatgttgggctaagaacatcattgactaagtttcttctatttctgaccaatttcctttttatttagtctggttttattgaatattatatggacaacatcattgtattgtatttgccattactattttatttcctaaaagctatcagtgtaactgagagcaggcttagcctctcactgcttttgcagaactgaagaacaagggctaggtgcagtggaaggaaagtgactttacttagcaaagctagcaatggggaaatggtccaggctcctgcctcaaagcaaccatctcaaattttggattaaaaaacaaaggcttaaaaaggggagcttggaatgcagggcatgaaggaggggtgaggaggtgctgctatacaggacttgttccaaagacttgagttattatccagttcggtaagtgggctggcgcatcccgcacaatcgggttgtaaattaactgcagccttgaggtgatctcctgatgagggagaattctgaaggtgcctaagtcagtcagtggaacttctaagcaagcattaataattttaataataattataagcgtaattagataatggaagcgctgtgcagggagtgcctggtgggaagaaagagagcaaaggttaccatttcattactaaaactggaaggaaaagaaaggaagaaagatctttaaaatagagtactcggttacatcaagatgccatgatttaacaagagactataatacataagtaacttgtttcctcagaaaaagtacttaatattcatggtattgtagtacatggactaattcgtacacgcagatttcaatttatgtgtgttataagacccggtttcaactttagacatgaagggtcacttttagacattaggaacccctctttctcctctcccagaaggcataatggtaggttagaggtgctcaccttttgactaggaagtagagaaagagcctcctataaagaaatgcattgtccagccactgcaggccttacttacagtgtcttatgttttgtttttatttcagttgtaatatcagacgagtttagttttaaaatgtggttttagtactcatatttgaatttggattccatccagaaatagatttatccagtgttaggttagggatgatatatgccatttatgcttatgattgctggaagaagaggcacaatttcagttgtaacttagatattttataattagcatttgtgtacattatcctgaaaaaaaaaaaccctcatctcaaaactgatgaagccagttatcttttttaaagatgataaattatagatgaaggattaggtattttaaaaaagactgcatcctaaactataaagttttttaatggcctccataaaatattcagaataattcacattatgtataacttttgaaggatgtggtttgtactgctgcaacataaacgtttcttttgctgttgtgaaaaaagcatttttctctaaaaacactgtaagtacagcaagtgggttgacagactaggaaaaagctctagctattccactatagtgttgacataggtacgcatgttgagttgcattgtaccgagcattttcacagatcatttaatttttcttcagaacactttgtgggcattttcctcattccttttgtacatacgagaaaaaatgaggcttcaagagcttagtgacttgtcccaagccatcgaacatggcaggaccaggctttgaaacccaaaatgacgttttggccgcactccacaccaaatggctaagcattggttctgacattgttttgccggttagtgaaatcacatttgcgattcagaagcacattttaagaatacagaaaacagtgaaaagaggatgaagaatgttaacattttttcctaaatgccatgaatagagcacgcatcagtaaattaaatgtctttcccattcttttataaaacagtgattatttttctcttgtttcattttagcatttataagaattctatttttccatttttaataactgatggaaacaagcatcattgtctgataaatttattttcatgctgtacacgtaactaccactttcatcatccactgttccaaacagatactgaaagtctcttttgtaattttctccttcccagtaattttctccatctacttgcagtgtatttgggatcctgacacctttccattctaggaggatgaagtgctttgggcagctatattttcttgtctgcctacagagactattcaatcacagcaagtgaagggttttgcagtgctagtacaaacagacaaggaaaaaaacatataatttctagttatttatagcctgtgcagctatgtggtcttatttatagcaaactgcacatttgatttgaaaaagtcatggtcatctggaggtcaaattcagatggcagactcaattcagagaaaaggagctgaactagaaggtaagcaagcctgttagactgggcaacttggacttgactttgctccttcaacaatctagagccagttggatgatatttctgcacaaaggtggttggttttacaggttgctcagtctaagctgcttctagtcaaataacaaatgtgaaaggagatagaaaaagctcttcagttgaactgataaaagattacacttagggagaaaatgtatgatggtttgcattataaaaacaataatttgccataaatcaggcatttctaggtttcaaacttttgtcataaaaaccaattttgagcattgcaattttagggacatattttattgttgttattttaaataaaaatctaaaccacaaatataaggctgagagctttcattttattcgtgaacataggaattcaaatcattaaaaaaaaaccctttctcatttgggataaagaatcttacgagagctgagttaatttctgacattagttttgcacctgcccatttgggtttaggacagtgcaaaaggtttcacatttaatcttcaaaatatagtatttgtagacaataaaattatataaatatttgtggattcatttatattttaaatatgagagtgtgaccattttttctggtgctgtctccatcagactgcatcccaaaaggcaaacagaccaactccttaatggcatttaatctctcaaagagcatcatgccaatttttagtcagcagattgcaccatgtgatctggccaaagtgtgtcccatctcaggctccttcatttgcgctgacatgtggtacaaacaactaaaccaaggtttctcaacctcagcactattaacattttgattcaaataattaatttttaggagtctgtcctaggcatatgggtgtttagcagtacccctgacccctacccactaaatgccattaacacaactccagctgtgataactaaaaatgtctctagacattgctaaatgtgcccagggggtcacattctggttgagaatcctgttctagagtagtagtttccccacatctgactcagagatagaactctcctggtgtaaacacgtgtactttccacaaatttgggggcatgttgaaatgttagaatgtcagcatcatccaattctcgacagatgtttgaaattgaatttgttagactattgtccaagctctcaatatttgcaaggtaaagtggaagttgctgttgctgtcctgactatagtattgaaggtctcgtagttttcctgctctaatgtaagctactgtggcagcagaagagaaaccagcaaatcccttagtttgaagtcattggttcacctatgcaccacccctttctcctctctgtttcatcttagtttcctagaatcccaggatatgctggaggacaaccatctgtagagatgtcctatagtcttgctacacaggttatttgtactttaggattatgtttgatggccttatagtttgtgcagaggtgtaggcctgaccccatgcaggattgagggagggaaaaagattgatttctaggcacatcagaatggtccagatgacatgaaacagactggtacacttacagagaatatgaaaagaattggaacttaacaagtcaggccccaagttccatccccaggttccaagtttgttgccgcagaagctcataattttcaaatcgtagaaaactcacaccacgcagcctttcaatggaatatgccaccttaaccccagggtcgttgtaaagacaggagccataagacagaagtctgaatgcctaggccatttaatctttggccaaatttgaactattgttcttaatcacactattcttgttcttttcactgtgcagtagcaaatgttagttcccattagcacattctgcaataccattggaactaaaactgccaaattagattaggcaacctgggattacactttgctccccaaccaacctagggagggagaacaattttaaagcattaaaagatgtgatggtgaattaaactacctgtcacgtcagtgccagtatattctatcagattaacaagtgtgaaaagctaaatctttggtatctggaaatgcttagataggaagaatggctttttcttcaaagccataataattagagatgaccctaaaattgaaaggaactggattgcttagcaactcagcattttttaaaaagaagggccatctactttgaatacaggttaaatatctcttctctaaaatgggaccagaagtgcttcagattttggatttcggaatattgatgtattcatgatgaaataacatgaaattcatttatgtttcatgtacaccttatacaaaagtctgaagataattttatacaatttttttttttttttgagatggagtctcgctctgttgcccaggctggagtgcagtggcgtgatctcggctcactgcaacctctgcctcctgggttcaagagatccccctgtctcagcctcccaagtagctggaatgaatgacaggcgcctgccaccacacacagctaatttttgtgttttttagtagagatagggtttcaccatgttggccaggctggtcttgaactcctgacctgaagtgatccaccagcttcggcctcccgaagtacttcgattacacgtgtgagccaccacgcttggcctatacagtatttttgataattttgttcatgaaacaaagtttctgtacgttgcactgtgagagaacaaaggtgttgctatcccagccaccatgatgtcatgtcagtgctcaaaaattatcagattttggagcatttcagattctcagattagagatgttctacctgtggtaaaagaatgttcattatgtctctgctctgttgtttagctatttgccaaaagagggtaagtggatcgtttaataaagtggtcagcaaatatttttcatacaaggccagattatagatattttaggctttgtagatcatgcagtttgtcataactacttaactatgcagtggtagcatgaaagcaacaatagacaataagtaaacaaatagacaaggctgtgttccgataatactacttttataaaagtagccagcagctgggtgcagtggctcacgcctgtaatcccagcactttgggaggccgaggcgggcagatcacctgaggtcaggaattcgagaccagcctggccaacatggcgaaaccccatctctgctaaaaacacaaaaactagctgggcgtggtgatgggcgcctgtaatcccacctactcaggaggctgaggcaggagaatcacttgaacccgggaggcagaggttgcagtgagctgagatcacaccatcgcactccagcctgggggacaagagcgagacttcatctcaagggggaaaaaaaaggtagccagcaagctgatccttggtttaatacagcaggtttttttatttttatttttattttttttccaatagctttggggatacaagtggttttagttacggggatgaagtgtatagtggtgatgtctgagagtttagtgtccccatttcactgagtagtgtacattgtacccaatacgtagttttttatccctctcctccttcccactcttcctcattctgagtctccaatgtccattatgccactctatgcctttgcataatcatagcttagctcccaatttataagggaatacatactgtatttccattcctgattacttcacttagaataatggcctccacctccatccaagttgctgcaaaagacttttattttgtggtttttctggcctactagtattccgtggtatatatacaccacattttctttatccctcattggttgatgggcacttaggttggttccgtatctttgcagttgtgaactgtgcagcagttatttttgaccccaggatgtgcgaggccaggtattttgagagacaccagcaaaggaatctgagtactggctatcaatacctgataattttattaatgagttgagacccagatatgccgtagaggtaaataaccatataaaggaaatatagaagtgtaggagaagattgctctggaaggctggggtaaaatgaaatcagctttatccttaagacctccatagaggttaactgtaccatctccttttactgctacagtttatatgaaactggacaatattgaagattttgacttttcgaactcatctattgagtgttgagcagctatgacaggttatttctttatgtgcctccattaacgaagtcaagaatagcttctgacaaattgacaaaaaacaataacctaaggttaacccattctggacgccagttattgctattgcttcacatatattttttagattcaaacttgaggttgcttttaagttttagtgtgatgtgctgaatagagaatagatgttaataaaaaaataatgccagcattcgttccttcacattcagttcatatatttgaaaaaattcccatgtcagtatgtgtccatggacataaaaaagaaatgtagcttgactagagtaaacacatcatagattatatttttattaccttatgtccatgtgatgcattgatagtgttctccaccaactatgattgcactgactataaaattgtaatacaagggcatattagggggagaatgcctttgttttttcttttgttgttattttgtttttaagagagtctggtattacactggaggatcacaaactgtattttcttgttataaatggctcctctatcttggacttaatggttaggataaatatttgaatgtagaatgcgttaggagttttaactatttttgaaattaggaaaatggagagacactttttttttttttagagacactttttttttaagttataataagcatggcactcggaaagctctgccatgtttcaagattaaagtttcacatgaacgctaacaagtttatatttcactcatatataaatgatcctccttgtctcctttcctaaattatagccatctcaaatgacaacattgctgggtcggtatcaaatagcattttcaatgataaggcaatgatttatataggtcttaatttgttttaatcttctgttaccaaggctgtagagataaattgcttttctgctgatgaaaggagactaacccaattttcttgttagaatctaatattaatatatcgactgaatgccattcataagccttggtttagggaaacattcagccttctggcctgttggagatggccacggtcattgctgtttgaaggtgggtcatttcttcttttgtgtcctgagtccattgtgactgtaaaattatgggtcaccccagagcctgaggaaacaaatgcatatcaaaatgataggggcaatctttcacagtgcctttaattttgaccccacattcttatatgaatgtgaagtaccacattagtatgaatatgaaatggagtgctccgcaatgattacaaaatcagaactaaaatgagggaaatcagtgcatgtacagttcaacttaatggattatcctctaaggagtcttcagacaggctaggagagtgacgtctgcctcatcctgaagatattagcaggttttcccctgttttaaagtaacttcccttcaaatgctaacagttttctcagaggaaacacaggtatggaaaatgtttcgttggtgtcttggccccagtgatggaggagcattttgtgataggaacgttgggtgcagcatcgccatttatgaataaactgaaagctaacctgtgttacttcaccccagaaaacagagctctggcaggtattgagaatagatcacagtgtgaagtggcagtattgtgacaagcatgcgtgtatcagtattaaaattgaaatgagccctcacgcacatgtgaaagcagtttctcccgttttcatattcagttccctgaggtaatacagcattttggtgtgagagaaagaagggaatctgacccttctcgtgtgggaagggggctgagggcaacaacctcctgtgacagccaccctggtccaagccaccttcatctttgtctcctttttttttttttttttttttgagacagagtttcgctgttatcacccaggctggggtgcaatggcacaatcttggctcaccacaacttccgcctcccgggttcaagcaattctcctgcctcagcctcccgagtagctgggattacaggcgcctgccaccacgcccagctaattttagtatttttagtagagacagagtttctccatgttggtcaggctggtctcaaactcctgacctcaggtgatctgcccgcctcagactcccaaagtgctgggattacaggcgtgagccactgcacccagcctgtcttttcctcttaaaagatcttccttctacttttgtcccatagcagccagagtgatccttcaacaaaacgccccatcacatatactccccctcaaacagcccacgctggtccctcagaatccttactgtggctttaaggctgtacatgatgtcccccatttcttccctgcctctcccactacttcctctcttgcttctttagctctggccatgcgggtctcgtggaatttgccagccagcttcaactcttagggcttccgtgctagttttgtcatctgcctgccatgtccttccagcagccagctgggaagatctgaatgtcacctcctcacttaagactctgcctggtcgctcacttactgcggtctacctttcccctctcccctcagctctcccgatccttctgaactctgctctgtttttctttttcctctttttctccataatacaaatcacatattaacaatatgacttactggcttttaaaaaattcttgtggtaattgtttctttccctagaatataattccaccaggatcagggccttcatgtttttctcattggtttctcccatgtgcctcacatataataagggctgcaatgttggtgggctggaggaataaaagaatgaacaggcgcactaaaggcaggatagtttgtccatgtcagagctgctgtctcagctgctttgatacctctgacttcccagggtggcaaagaataaggatgtggcttatgtagaaggcgttagtcatccaaaatgccactgtatatttggaagcaaatattcaccttgaagcagtgatgtactaggaattagaactgcttttctgttacattttttcatttgttatgagtgtttagatacacatgatcactattaaaaggaagggaggtaatagcctatatatcctaccatgcccctcaaggctctgttaggagactaaaatacaaaggtcatttaaaaagttaaaagcttatgcatgtgatgttggtattgctgctaatgactaggcatctagaggtcaaaacctagagctaaggatattgaaccctgtgttttgtctcgttttaagtctaggtttttgtggaggggggaacatacctagccagcttgcttgcagaaggcatgagtgagcaggctgaaggagggacccaaggccagaacgtcctccatattctagctccatgggctctttcacttgatccctgctttatgacccaacttctgttgaaggatttgccagatagtgtttggggcaggaacagctgtttcatagaaaacaagccaacggacatcataacaaagcatatggttgttttgccaagttgtgctgctcattaacaaaacaaaacaacaaaaaccctttacagtgccccagcatgtggatggattggccctttactactctaaaaattagctttacagcctttttatggcttacccaatcttaacagactttatttgtgtgtgtttagggatgcaaatgggtatgttaaatgatagtgttttgcctctacgcaataaaatagggtaattttttcttcccatgtattaaacgagaacacagaacatgcctagcatggtgggctctgatgaaaagaggctgttatcatttggccaacatggaaatcctagcctttatttatttatttatttgagacggagtgccaacatggaaatcctagcctttatttatttgtttgtttgtttgtttgagacggagtttcgctcttgtagcccagactggggtgcactggcatgatctcggctcaccgcaacctccgcctcccaggttcaagcgattctcctgcctcagcctcccaagtagctgggattacaggcatgcgccaccacaccctgctaatttttttattttattttattttagtagagacggggtttctccatgttgatcaggctggtctcaaacttccgtccacctcggcctcccaaagtgctgggattacaggtgtgagccaccccatccggccgaaatcctagcctttatcagaggttccgtggaatctcagaggtctgtgagcaggataaactgctttatggtagtttaaaatgcaaaaccagaaataaaccctcctaaagccagtttgtttccactttctaagtggttacagtgacctgtgttttaagtaccttaaatatatcagtgacctgctgatatacagcttcctgtttcctctgtgtcctgtgacatatcctgacattccttgagccccactcccttcccaaaaggaagtaccttgatgggtgaggacatagggcacacgtgtctctggccttctgtggacataatcacaaaatggtagtcagtcctatgaatttaatctctttaggatataaggatattcacgaaatagaagttgagctctctggacatactccaccttaaaattgctctctccttccgggatcctcaccagctgcagagcagtagtaatgaactattaaattcatttaacaatatcagcatatgctatccttctctgcttgactagacagtaatctggcttgctggttggtatgaatataggataatttcactcacactaattgagatggggagtttgtatgaatggctgaaaaatttgagttaaagataaaaagagacacagcttcctcaactatgggaaataactgggactgttaacaaagatttacttgaagagaaattgtattgctcagggttctccagagaaacaggaccaataggatatatatgtataggaagagattgattctgcagaattgactcacacaacaattatggaggctaagtcccacaatctgttgtctgcaagttggagacccaggagagctggtggtatgatttagtccaaatctaaaggcctgagaaccagggaagacaatggtgtaaatttcagtccagggagaagagaagaccaatatcctgactcaggcagccaggaaataaaaagggtgaactgctccatcctctgcccttttgttttcagaccctcagcagatcgggtgattcctgcccatgttgaggagggtgatttactttactgagtgcaccaattccgatgctaatctcatccagaagcaccctcacaaagacactcagaaacaatgtttaatctgggcaccttgcggcccaatcaagttggcacagaaaattaattaccacagaaatatttctggattcaatggattaagttggtaatatagtattcatattcatttccacgtgcctaaaaagaaggtttttatcctttttaatatcctcagtcctattaaacatacctcacattcatgttccatggttattctcttattatgttgctaagtgcatttctacttaggccaatctgattatagtgattcagattatagtgtttatcttctttcctttatacagtagacagtgttcgcaaaccataggagctgaaaaaatttccttcttatatagtaagttttatgattccagttttccaaaggggtgcttatgttatggttataacagttacagccagatgactatcttcatcagcaggtataaccccaaatatttatacattttcatttgtttcaaacataaaatatggtttgcctaaacatgtcattctgccagattggactatgcaaaagaatgttactgttttattttctgcttttactttaacttgttctcatttgagctctaccagttaagatgagaagatgactaaagctagggaagcacattttaaatgctaaataccatgttcatttcaagttgggaacttgaaatgcaagtatttttaacttaatcattaagttaaagtcagtaagaacgtggtatttagcatttattcattttaacttaatgattaagttaaaaatacttgcatattggtttgcttgaagctatggagaaaaacatttaccttttttccaaaaaggtcttaatattcaaaattattgtttcaatcttacaaattaacaatttacttatttttgatactttcggccttttttatgtgggctacacctaacattttttgaaaaatacatactgcttttcctgtaggttgcactttgtgatcctgtgtgtaattcattttcagtggttctattttatttattttttgttagtttgtattttcttttgtttctttttctcaatttttaaaattttaaaacttgtccttttcttttttttctttattattgcactcttctaccaaaacattttcagtggctttgaataaaagtatcagaactttcccgtggttagcattagctctgagatttgaacaggatgtattaagcagaggaggagggaaggccactaacatgtatgagctccactgtgtgtcaccctctctgccggatgacttacatgtggtatggtatctcattttcccagctctcctatcatgtcctgcggcatgttatcaccacttgataaaaaaattgaaacatggagtgcttaagtttcctgccccaggtcacagctgatctgaaaaagaaatgggattcaaatccaaatgtgcttaattgcaaatccccacatgactctttccttccttccttccttcccccgttgctgccaatgtaagaaggaacaccactccctcatttgctacagagaagacaggggcagctgtgtaaaggcaccaggaatatgccctgcctccttccttccacttgaaagcaacatctggatagacactcaactgcttttattttttgaaaaatgattattaatcaggattgaagtggagggaaaaaatcaaaacgaatgtttctttttaaaatgaaagatactgtttaattatttaacagccttccggttttagttaatatctttgaagactttggattaagattccagacattttcttgaaggatgtagaaaacgtatttaacttcaagtttagtttcaaaatgacttagctatcaattcttctcattgaagtcctctttgagatattatatcccaaatgtaatacacaggtaataattcaataggaatacttggaacattggtgatatttgaataaccttttgaatgaaacaattgatttgatctcaaaagatagtgaaaacgtctcattttgttttttatgttaaatatgcttcctcttaagtcaaaattcttttttctttttgcttttaagctcataaatactctgaattctcactaatcttttggaaaattgcttgtataggtattataattcacttggctcatgagttacataatatagcagtatatgttgcaattcaaatattgcttagcagtattagttgaattcaaaatagaaatcactttctttttgacaactagcataatgaattcattgactattgtcaaatttatgaagacagaaaagtccttttgtgattcaaaaatgtgtttattgatgtttatatatcttttgtcgtgtttccatactgtctcatgaaggttgtcttcgtaattcagttatctaaatacatcatacatttaccttttccctggggtgccgttattctacaacaggctaattacagatatctgtggtttctgcaggagtcttagtgtatgatattgatgatatcatcatttactttcaaaattgcaaaatagtaatttaggaaagcatggggatttggaaaaacatgtcttcagcaccaactgtttttgctctttgcatgcttgtttcgtaaagaactctaatgctataattgcaaaatggaccattttaaagatttttccttcattctgtacttgggagtggtgaaagacatccttactgtgctgcacagtgtctcatggtgttctcttaaacagcattaacgtcttgtatgcgctgctttactaaattctctgttctgagaaataactgaaaatacggctttctattaaacgagtggattattctgttgttgttggcttttttttctcaaacctccttctcttctactttatagttcctacaacagcagccagtacccctgatgccgttgacaagtatctcgagacacctggggatgagaatgaacatgcccatttccagaaagccaaagagaggcttgaggccaagcaccgagagagaatgtcccaggtaagtctggctcttccatcattcagccctacgatattgggaaacctgagcttgcctctgcctcagtctccccacaggcctgctggctttatcaagatctttaaagatgtaaagttctaattttaaatgtttactgtgtgggcacagtttgtgggttttttgcatcctccgtgaacatgctgcctaggaaggatccaggtatagttggattttgtaagcacaaattaaatgatgtctgtaacattctctctggcgaagaaaggtacttggcattattattctgtgtatatgtagtacctgtaatcaacatgttgtaaattaaaatccatcaaaatgctctttagtaaagatgaggttttgtattaaatcccagactgttataattgtgaacctacgattgtttacagtctgtaaaatcatagagacttaaaactgagctgaaccatagtgattatttcatctagtctcctaagtgatacatagtggaatagaggttcgagagagtggcttcccattttagcacaaagcaaaatcagtgagccagagacaacatttagaatccaggcctttcttgctcctagtacagtactcctttcattatactttgctgaaaaaaaaaaaaaaaaaaaaaacctgttttggtttggtttgtttttttttagcaggtccttaattaagcaaattaaaaaataacttatgtctaaaacatggctaatccatatatactatcaactacaattgaagctatgtctgctaccaggcactggatgttgtattggagtttgataatatggaggattttagcccttgctcagattcctcattcattcattcattcaatcaacaaatatggacttattattttccagtcacttttctgatttgtagtctacaaacctaggagtgaatgtggggggaaaagaagtaggacataaaagtgaatgaataaagatctcaggttaaagtaagccattcatttttagtgttaatattctgtggcaaatatcagaagataggagaaatttttgtcttagcacagatgcttaatctcttgagagacattaaatgcaatttatgaattagactgctgcgtattttctaagatcacagtcagtctttagtagacaattaatctttcctgtaatttctgatctgggtccctgctgaccccaggaagattcctccctcccagggccaaatgaatggcccctgagcatgtctttcccatgcaaaccagtcaatcaaaagctccttactcccaaccaccttcttatactctgggccactattcacctgctctaatcaccccaggaccaggtaccagaccactagggacaacctcatgccccatcaccattatttgaactaatcagtcctaaacccgcctaccctgcttcgctcattctttccatgaaaaccacaataaaaggctcttgctcatgttttcccctcctgaccaaccctggtgcttcccatatgaccctgcatgtagtggcatgtaccggcttcttgggagctgagtaacaaactgtcttttccatgataatcatctcctgacctcttggcctcacctgaataataagaaaatctacccttgaaaacataaaactaatagtttatctagaaaggtacaacacaggtactgttttttgtttgtttgttttgttttttgtttgtttgttttgccttaagatgaataacaatacttggatctactttggtataataacataaagaggaaaaaagccttataatcacagtacttttggctctggaatataatgtgcagttctagtggctgcccacgatgaaaacctaacagctaattgaactagaaagctagccacagggaattattaagttttcacctgatgccaagaaaatcagatctttccttaggaaagacacaggcactgttcggaaagcattggaggactatgaatcatacttattgccactgaaatgtcctcatttgaatttacatcctatctcccttctttatgaagctttcagaggcttcctgtgccctcacaaatccacttctgggcacatgaagtcgtaaaaaaagaacaatgacaaaaataaacaccgaatgctcagcttgtcattttcagcgcctaccactgtaccctgactctggtcttcctaccacctcttccttctcaactgctacccttgctttctgtacagcgttaagctgctgttctgatcaggccactctgctcatcgtctgttcatctcatcttgggcttccctttgcccttggcattgagttcttctggaaatgccctcccactcttcttcacgctgacacatctcacccattccttacaccccacttcatactcagaatgagacaggcagtcattgctcttacctttcatttaattctaaatatttgctccccggttttgttagtgatttctggacacacctgcattatctttccaagctggatagaaaccttgagacctcaagtcatgaagcctgctacctgcattcatcgtggacccactgtagcattttttttaatgtgtgtttttttaatcctggattttttctcctagtatatcttgttcatttttgaccttattaagaaaacttatttcaaattctctgttagttttagatgtgacaggtcttctttaaaataataatttaacttttagcacatctgtgtaacttgtgacttagttcatgattttgtagattttgttcatcttttagtcatcagatatatctgatataacctaagagatgttgtcccagagcagagaatgttgtctactagattccagtggtcataggaatgtgagacacctgaaatcaatatgtatcttcatagtctgtggtgctgaaatctagggacttttcaactttaaacttgcctgcctcttaaatctctacttagtagtagtcattttctctgcatgaaacagccaagtctttgaagattgataaatccaaatgaaattgatacctttgtgcctgcagtggaaaattgctttataagaatccatagagccactgcaagggccaggtcctgagaattttaaattttaaaaattgtgcggttttttaaattaagttttattgtagtttttgttatatgttttcttacaaatacagaggattttggaattttttcatattttggtttgttgttgccattgtggagtataactctaaacctgtagatttttgttgctaaacctgtagatttttgttgctatatgtcgtgactagcatctagtcaaatagaaatctacagctgaaccatgtgtgagcacttttattacttataaacttactacttttagtatatgcttaaaatgaagtccttcaaattgaaagctgacccaactcataggtttttatttcttttcttttttggagatggagtcttgctctgtcacccagctggagtgcagtggcacaatctagactcactgcaacctccaactccctggttcaagcgattctcctgcctcagcctccccagtaactgggattacaggcacgtgccaccacgccgagctaatttttgtatttttagtagagacagggtttcaccatgttggccaggatggtctcgatctcctgaccttgtgatccacccgcctgggcctcccaaagtgctgggattataggcatgagccactgtgcctggcctaggtttttatttttaagataagcagcaacattttaagagcgcccctttctcctgtcactaaatataaataaacttagctcacctaatgaattttttattttataataaaaaattgggtaccacagggtacaaaaacatgatctttagagccacagagatcttggtttatattcttccctctcccttttttacctgcatagcctcgagctggtaccttaacctggttcgtaaaatgggatggccctggctaatctcacaagctgttgtgaggaatcaattaaattagatagattttgtaaagctcttaatacagggtcagcagtaatgctacttgttatcagtcccacagtgaaattcactgttcacagggagatggtcagcctacatatagtgtgtattcatttgcagtagagtcttagtgggatggtgcaggtgatttgtttatttgtgggggtataggatattgttaaattgttctgaaaatcaaaatgtgagttaatttctatagtaatgcttatttgcaactcattagctaaataaatctctttaattatttcatggattcccccagcttaaagcttaaagtccagtttcttaaagtgtatgaggtaaaatggaaaaaatgtaaatgtaatatgggaaatcagttctcacattgcagtagaacattgaacttctatctcaaactaattttgagattccttgcttgaagaattgttggtagagtaccaccactgtgaacattcccaaagcaggaaattgaaatatttatattgcaaggcttatctcatctataaagcaaagatggtcttccatttcccccttgcccacaggttccctttattaacttggtagaagcaccaaagcagatgggacaatatgtttcttttcttccatgttctattcttgttcattgcagcagggcatttgtcccaattttgctgtgaaccttgagattatttttgatatgcttttcaagtgtaatgaaatatttattccatcttgtttcctccatggttttacaaaaacaacaagaagaagctaattgcctatcatatacaaagaatgaatgccaatggacaataaaatctgtaattaggaacccacatggtgatttgatatagtattgtctcatagaagtcttctatctatagttatttattccaagcctctttttctttcccatcttgaagtatgttagaagagtctattccttaaggctaagtacctacaaaaaacaggctcttataatacagtaatcaagttttctcatgctttgggagtacacagagtatgcaagtacacatctggcaccaaaccaatattttgtttccttgatctttcttcattttacctagttcagagttgcacttcaaacaaattctacttgtcatacacttgaaaaggcagctgtaggtggtaggaagttaatattttctttgaacaacatacagaggtgcagacttttactttttgtatcaggttaatgagtgaacttctctcagggaaatccaggtgaacatcaaagttgagagcaggaagcattgatttcctacaaaacacattcacctgatatcttagtcagtttgtgttgctataatagaataccccagcctggataatctgtaaagaaaaagaagtttaaaattcggctctcagttttgcaggtggggaagtccaagaacatggtgctggcatctgttgaggacttccttgctgtatcatatatggtggaaggaagaagggcaagaggagggcaaaactgagttttataacaacccacttctcacaataacaaacccactccccccataatgatactaatttactcatgaggacagagactgaatcacctcttacaggacttacccctcaacattgttgcactggggattaagtttccaacacatgctttttaggggttacattcaaaccatagcagttggttactaaattagtgctacttgtaaaaaaatacatgtttgctgcattcagaatattacatgttttcttggagtttttggaaggacttagcgtaatccttgctgttcatgacttaggttggcaagctcaaagggccttaattccccatcagttctttaaagggggataggtcttaggatattagacagcagaagtcttctttttcttcccccattatgtactgctttttggcattgtattcatgacacacacacacataaaatgtcatattttctttaaagtcaaaatatacagtttaaaatggtttcagttgctttcataagagagtaaaacttaggtgttcagtttaatattggaagaccttgttcagttaatgtgtgccttccatgaatagttggtatttgttcacatcaaatcaaatgactgtcagttctcggggtaaaaaaagaccaaccttgactcaaaaagctatattcctgcaataaatatgaacatttatgtttaatatactgctgtgattaattatttatatcctagtgggaggtcaaatattcttcagataggaaggggtatgtaataaattttttaaatatctaaaatgacaaaaatagaggaaaaacataatcatccatcctattaagtctgtattcaaaggatgaactgatgattttaaattcaaatgtttccttaatttataggtcatgagagaatgggaagaggcagaacgtcaagcaaagaacttgcctaaagctgataagaaggcagttatccaggtaaaacctgaacccatttcctaccaaacatcacatgccagcagtctttttaatgagtgtctgcaggtttacctttatctgccagcacctcacgtgtgattgttcatagtcccatgaacttcagctgttcttaatcattgtctagtaattgagttgtttaaatcctgccttatatttgctcccaattatttcaagttataattcattgccataaaactcacattgtaacttgcaatctactttttattaataatacatcttttcagtcaccacaatcttctgctgcttctccctccagcaaaaattatgagaatttgaatttttgatggaaaccagtctcaaaattaccttaagtaaaccaacagtttattatggtcaattacttgaggtactgttagtaagagagggatttttttttaatatgtaatataagagtttcaagagtgcatatatttatccaaagttattagtcaaatcagccttcagagagcctatgaaatactgattttcaatgagaaagtaggtttgatgagggttggagagtgcaagaaagtgaagtaagctataaaacgtagaattagtcaatgttggaatgactatgcagtctttaggatactttttagcactagaagaaaatggaataggatgtcttttttagaagacttgaaattgctgcttcatcctacttattcagtccccatggacatatgtgtttatgatggcagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcgggtaggtctcgctgcagccgagttcacacttcaggtcacagcacagacagtaagggtggggcactgggaactggaagccatacaaaaagaatgaggagaaatgccttgagcactgttattcagaggttcaacccctgtccattccatcttgaaggtcaaagggtcacagggcagctacctccacaaggtcatctctacacagcaggtactcacacttccccacagagcagccagacaggactcccagggactcacattgcaagccctgacttgatttaatattcctgaggtggtgacaattgatggcatagttcaagttcgaacacaaaagctggaaggatgtcttccagtcccttcaggctgctgtaacagaataccatagactgggtaccttatcagcaacagaagtttatttctcacagttgcagaggctgagaagtccaagatcaagacatcagcatacttggttgtctggtgaaagtttgcttcctggttcatagaacttaaattttgtttatcttttatttattttatttttgtttttgtttgtattttgctgtatcctcatatggtggaatgggcaagagagctctctgggccctcttttataagggtactaatgtcaatcttgaaggctctgccctcatgcctaattgtctcccaaagctttcaccctcaaatagcatcacactgtggcttaggtttcaacatatgaattgggggtgggagagacacaaacattcagaccatggcaaaggattttagaagtaaccttgcccagccccctcatcatgtaagtataataatataactaaggtcaaggaaagttgagatttggctgagttgtaagaatttttagtggaccagaaagaattagaactcaaatttccatctcagagcagtggccatattctctgtggggaagcatttgtcagtcatgacattagcaatgatgagacttattcatggttttcagtgatcattgccccaaaaaggcatgttgagtggtacaggcatagatgtgttcaccggcattctgtgggagagcttacttggaatggaaggaactttctgagcatgagtgtgtaacttatgtccacttgttctttttttttttttttttttttaaatgagatggagtctcactctgtcacccaggctggagtgcagtggtgcaatctcagctcactgcaacttctgtctcctgggtttaagcaattctcatgcctcagcctcccaagtacctaggattacaggtgagccacgacacccagctaatttttgtattttagtagagacagggtttcaacatgttggccaggctgatctcgaactcctgacctcaggtgatccacccacctcggcctcccacagtgctgggattacaggcgtgaaccaccatgcccagccatttgttctttctgtttgtcattgagcaagggatattgaaagctctgcctgtgattgtggaccgggccatttttctaaacagtgctatcagtttttattttgtatagtttgaggctgtgtttttaggcgtgtaaatgttccaggctgttaggccctccttgagcctcttcttatgaaatgatctttttatcctttgtaatgttttgctccaaaatctactttaatattaataaagctattccagctttcttttgattaatattaatgtggtgcatttttccatccttatactcttattgaccttgtttgtctttatatttgaagtgtattttttgtaggcagcatgtaattgggtcttgcgttttcctttggattgggaagaccatgtacactgaatgaggttatggatatggttgtcactgaatctgtcatcttgatatttgtttgctatttgtccagtctgttccttgttcttcttttttcctcttttttttttggattaattagaaattttttatgattctattttatctcttttgttggtttgtaagttacaactagtttgttattttactggtttatctcctttgtgggtttataagttataactagtttgttattttactggttgctttaggcttatagaaaacattctaaacttgtcacgatgatgttatgtcagttcaaatgatattataccactccacagacagtactttacaaaagtacttccatttttcatctctctctctctctgtaagcggttgttgtcatactttttccttactacattgttgatgtttttctttaaacagttattttttaatgagttgtaaatttaaaaaaaaaacaacatgtttacccatgaagtcatcattttgggtgctgtaaactctttgcgcagatccagctggtatcattttccttctgcctgagagatttcctttaaaatgtcttagagactgggcttggtggcttgtacctgcaatcccagcaactcaggaggttgagataggagatcacttgaacccaggagttcgagactgcagtgagctgtgattgcatgactgtactcccatctgggtgacaaagggcatcctgtctctttaaaaaaaaaagtttgagtgcacataagttggtgatgaaatctttgtttggctttgaccaaaaatgtcccttttatacctttggttttgaaaaatatttttgctgggtaaaaaatactggattgaggtttctctttcactgcctgaaagatgatactctgctgtcttatttgtgttgatatctttatctttatttctctaaaaataacatgtcttttttttctgtttttacagttttctctatatcactggtttttaacaatttaattttgatatgccatggtatcattcagtctgcccttaattccatctggccgtttttcatcttatcacctcacatactgtagttgttgtatatagaaatttaacctgggctacccccaacacccataatatcgtctgtatcttaacttttgaacctatggaatacagttattatatgaaaactgtttaaatatccatgtttgctaattctaacatctctgtcaactttgaatcaattttgattgcttattattacatgtggcatttccctgtatcattttatgcctcataattttttattaaatgtcggacgctgaatttaaacctgttgaatgctaggtgtttttgtaatattcttgagcttttttctgtcacatagttgagttacttggaaacagtttgatccttttgagctttgcatttttagatttgttaggtgggatagaagcagttatcagcctaggactagttattccttactagtgaggcaagacccttctcagtcatctaccatgaatgttaagttttctcacctgactcgtgggaagaggcattattcctgtccctgtgtgaacaccaagcactgttaatgctaattctttttggtgattttccccctggcttcagtttctttcacatgcatgtacccatcattactcagctatattctcagggatcactctgcacatctctggattctcttttggagcaactctctcctcaccaataccctgtcctgtgaattacaactaccttgatctctccacacacttcatgtcctccactccacgagtcctctaggctctgtgtgggtttccccacctgaaaccatgacctggaaattcagggccatgagtttggcagctgtaagtcctcatttgtttccccttttcaggaatcagtgtccttcacctgatgtctaatgtcttgcagaaatgttgtttatgccaggtgtggtggctcacgcctgtaatcccagcactttgggaggccaaggcgggcggatcacgaggtcaagagatcaagaccatcctggccaacatggtgaaccccgtctctactaaaaatacaaaaaattagccaggtgtggtggcgcacacctgtagtcccagctactcaggaggctgaggcaggagaatcacctgaacctgggaggcagaggttgcagtgagccgagattgtgccactgcactccagtgtggtgacagagcaagactccatctcaaaaaaaaaaaagaaacgctgtttgtatatgaatatattgtccagttattggtggttcaggcaggagggtaaatccagttcttctcactcaatcttggctggaattgtttgtgcattttatgcaacttaaccagaaagtcacccatttgcaccgattttcctcaccattttgatttttctttctatggataaagttacagtgcacagaaagccatgaggagccgttaaagagctcgtggcattcttccaagacgtaagatactatttaccctgttctaccgatgatatcactgcaacctcgggagatggagcggctggttcagggtgacactgctgggaagggagagggtagagccgcgagtcactgtggtgccttctcactagaacgagcttcctctctaaacaaagagcttttgaaaaagaatattcatattagcgttttcattttctatttgccaaaattctctatcttagcaaggcacttgtcaggaaatttttttttatatctctgcagaacaaaagttccttggttcctctcttttttggagaacacgctttcaggagaggagccgtgtgatcatttgccagagaaggataggctggtgggtgctgagaccagaatctttatagcagaaacttgtgaagcgttccagctgaaagtccaatctctaaagtaagatctttgctaaatggacattgatgggactaaaaataagctgagggctgaatggaggctttaacaaatgtacatttaaactctcagtttagtctcatcagccatcacaggaaaggcagtggcaagaatgtttgccgaagtgtcatcttttatcaaaggggataattttagagtggttgtaatcgtgcttattgtgggcctccgcattgcttcatatggaattaggcaacatgttcatttgaaaaaaaaattaaaaactggattaggaagaaatattttactgtcaaaaatcagatcactgttgttgattgatctaaggattcctgttaaattcttaactcggatttatttatttatttatttattttctctctctctctctctttctctgtttctctttctctcctgccttccttccttccctccctccctccttccttcttcccttcctttcctttcctttccttttctcttcccctcccctcttctcttctctaatcttctcttttcttttctcttttcttttcttttcttttgttttcttttcttttcttttcagggtcttgctctttcacccaggctggcatgcagtggtccagtcgtagctcactgcagccccaacctcctgggctcaagcaatccttttgcctcagcctcatgagagttgggtctacagaagctccaccatgtgtggctaatttttaaaaaatttttgtaaagacagggtctcgctgtgttacccaggctagtcttgaacttctggcctcaagcgatcctttcacctcggctttttaaagtgctgatattacaggcatgagccaccatgactcacctttaaatctttcctttgtaataaaatgtggctgggtggtcacaggcctggagtctagggggcattacttgccatttttgttaagttaccatctttaggtgttcatttaagttttaatgttgtatggcttgacctggcacttaggtctgcactttggcaggcacaagaaaattgtaaataccttcttttttttttttttttttttttttttgagacagagtcttgctttgtcgcccaggctggagtgcagtggcgtgatcttggctcactgcaagctccgccttctgggttcacaccattctccagcctcagcctctcaagtagctgggactacaggcacccgccaccatgcctggctaatgtttttttttttttgtatttttagtagagacgggctttcaccgtgttagccaggttggtctggatctcctgacctcgtgatccgccagcctccgcctcccaaagtgctgagattgcaggcgtaattaaatgccttcttgaggacttttataccttcctcttgaagacataaatccagagcttactggtggttgtctgaaaaagatcacatcttgtaataggagtcatacataaatatttctgagatctccctcatacttaaccaccgtgcctggaaaatgcagacaactgtattcagtaaatggtatttgaatataagtaaatcaaaagtgtcgtttccatagattctgtagatgttaccacttagaataattacctgtctaacccttaacaaattctaccgtatattctcagactttgcaaacacgggattccaaaacaatgtggattgttttcagtttctttgaagctcagatttaaatcatacttttactcagtttttaaacctaaacgtggaagtgttatgagatgttgtttttgtgcagctagaattccttgttctactaatgaatttcatttcctgagtccctgtgtctgagtatactgtatgtttcaaatttctgatttagttatgtacctataggcaaatacactgaatggtcaacctaaaaatgcattgtttgactcatatttagagtcatacatatataggcacatgtatttaaaataaatactttaggctagatgtggtggctcacagctgtaatcccagcattttgggaggctgaggtgggaggatcccttgagcccaggaatttgagaccaccctaggcaacatagaaaggccctatctctacaaaaaaaaaaaaaaaaaaagatttttttaattagccaggcatgatggtgcgcgcctgtagtcgcagctactctggaggctgaggtgtgagtgtgaaccaggaagtcaaggctgcagtgagctgtgatggtgccactgcactccagcctggatgacaaagcaagacgctgttccaaaattaaaagttaaaaaatgagataaatacttgaaatattacaattattaaaatagttgttttccccatgggaaaaaaaagttgagcagagctgtgtctttgcactcagaaaaaactcttactctgttgaaggctagtgactcttctaaacaccaaccccttcacctttttactttccttagactttctttggaaaatcaaggagttagcactttttccccctggaagaattaaatgcctctccagaactgcagcacaggaggttaacttctaccacctttggaggcctgcaagctaccagattaaatacttaaagctaagcattcatcatttcttaacctgccctctacagtcatgcacttcctgctttttactttgtcagggctcgtactcaaactattcatagcttcatgaaacaggaactaaatgctgtctgagcctttccccttgtaactctcagcgttctgcttatccttcatagacagaagatgatgatatgtcctgactgttgaagagaaattagacttaatgtgatcctgtacagttaaaccaaaggccagatagggattttttatttcaatcaactttctattgtaggcctaggtttggaaaaccttagcaccccctaatttgtaagacttgaactgttttaaagataagggatacacagccaaagctttctttgtaattctgagatttttggtgtttttacagatacttagtctaaatctttcatcagacagttatcatgattattattctgacttcaacaactgcattttctaaagggaagtgagaattaggaaacattttcctgtacatctgtttatctatcccagttgtgttgtttggattttttcagtgtcttaacgattgaaaccatcttatccatactgaaattcatttcatgcttctatctgctgcttcacattcaggctatcagtttaattgagcaaaaaaaaaatgttggcagtttctatagcatcggcatccttctttggtttctcatttttgaatggttcagccacatgttaaattttgctgagatctctggaaacttcttcacataattctttgatagaacatgaattctgtgagactcttcattaaagagcacggtttcatcactaagttgagattttgctcaaggctatttggtaaattccagcagaagagcaataaatgttcaacaagaaacagccgtcattggagataacaagggtagacattaatgggaggtttgtcacaggtaaacaggtgatggcatgagaaggtttaaaccacctcataaataaatttttcgccactatatgatgtggattacaactaaaccaaactttaaccaatgtgggtgttggtgtacctttcttttctaaagcaaaaaagaaattgtggtactaaacttgagcttttatatgataccgctaattgcccttcacccaacaaaccaattatttctacccatcacttttcgttgcaaaagaaattatcttataaaatatatgtatatagcatatatctccaaagcaaatatgggacatctgtacctcaatgtaactgatagtaagttaaaaattatttgctgagttcttggtatgtggacagatgaatattataatgtttaaggcattccaccagcaggttttgaatttaaccaaaattttatgaagctaatcagaatggaattaaaagttgaaagactgccaggccaaaaagatcatctttcagaaaagtaaataattgctctatacttacatatttattatttatttgttcaccatccgtttatttttagttgagttctgtatacattggtgagcaaagggggactcattagcttgggcactcctaagggcaaacccaataacagatagtgaatgggaaggaaaatgagagaattagcatttagtgaacaaaatcttataaactatgctgaatggtatacatgctctttcagtaaagccactcagtactattacttccctaccttctgaatgtttaccaagttcgataaaatcttgctacatacaaatgggaagtatgtaacaagagatactagtggtttctgggtttaattaagttacatagaacattaagaagtatgttgggaaggcattagcttaaaagctgtcttttgccactgaggccatattcatcacccagattccctccacagtggagcactgctcagtcactgccttcagaatgcaaataggtcttcacaggatgctattaaaacccatagcaccgtatggttttacgctctgctttcttccagcaaacctacgtattttaatgttaatatatatgttcattttatctttgagaatgaaaatgtattatgaaaatataaatatttagtttttgtagacaaatagcacatttaaagatccagtagttattcacctgcctggtatgactgatagagaacagatgggtagcaaagaatcctcaccctggaaacatgtacgcatacacacgcaaacacaatctcgcataagctttaaggggttcattcattttgtgaaggttgaccatggataccagtttaaagatgccaggtgatgtttggcttttaagtatcatcaccttgagtttccttatataaatgttttaatatcaacaaaaaactcagaatttctaataggtcataacactgcctaggtatgggaagaggagagggtaaaattaaaagaaatgcaaatgtacttttctttgaataggctaaccagttagaggatgtatgaagcaggaccaccatagtccaagtatgaatatgcaaaattaaagcagattgctgtaaatctctcttaaaaagtcaagaatatgtcacagttggcatttttcggatgatcagaccgtttgacaaatctctgcaagggtccgagttagtcgaacatatcttttgcttatgatttcagcaacactgtgcgctttgccttctgggttgtattactaattctgttcatcattaagtgtacacatgtttcactgtttgactaaacaaagcttgaagacatacaagtccaaacattttctgtcctttctgtattcccaggtcagaagatcttagctctttatccattctgtgctagagtttgtctgaaagcatgaatcatggggttgtgttgggtgctaaatttcagttctatatgctgccttcactaatttatgactgtggtctgaacaaccaaaataaattatttctgagaactagcaaaataccctggaaaaaatttatgaaacctaccagatttgtaaaaaggtcagccaggcgtggtggctcatgcctgtaatcccagcactttgggaggccaaggcgggtggatcacctgaggtcgggagttcaagaccagccggaccaacatggagaaaccctgtctctactaaaaatacaaaattagctgggcatggtggcgcatgcctgtaatcccagctactcgggaggctgaggcaggagaatcgcttgaacccgggttgcagtgaggggagatcaccccattgtactccagcctgtataacaagagtgaaactccgtctcagaaaaaaaaaaaaaaaaaagaaaagaaaaaaggtcactaagtgatgagagaattaaaaccactcctattttctaccttttataacataaactcttgtctttacttcccaggtttgccatctttataacctgtaactaggagcaagtgatttaataaagggattcctcctattccgtctgcaaattggagttaatttttctcctctttctgcaatttctgttgttttagcttttgttagccataattagaaaatcaaaaggattcattgaaagttgagacaaaattgtgaagtaggaagatgtcttcctccgtaagaggagaaagattgttagaggaagtacatggaggctttggtgacacatccctatgaggaagtgatctgcttccacgggaaggagagaacagatgatagatgactcctagatgctcctgcgtcatgttcagtacaaaatcagagccgcatcagcaaaccggataccctgggaaggaacattgggataactccttggccataaacaaaagttttgctctggccttatgaactaagtggattaatagagattagttgttcaatatccttccatctaatggatccatattgttaaaacttaagaaacaccaaagggggagagtgtgagaatctactgccattttctccattgcttcattcaagacttctgtgtccaccttggcatgggattatcatttgcccttttatactcaccttaaactacaaagatcatttgtttgcctttctgaagaaaggaaggtggataaattttgcaggagactttaaaaattcagctcaactcctggcattaaagacaataaaggtggtgattcagaggtccccatggcagtttccccaaatattacgtttaactaagatcatctcaagcacagagagacttaactctctaaagtgtgatttttaaacctgcacacggaaattttctacattttatatgctcaagatttcttgaaatccagggtgtaaaactgtgaaaataatagttctgaacctatttatgaaagcaggagagaattgctttgttcagttttggaaaccaccagggtgcaatttaatgctccaggagagggttttctgtgacctggaaaggttggggtgattcccgtacagtgagtcatttacttccttcttggcaggattatgcccagggcttttaaacgctcttgacacttcactgccttccataagaaacgggtttagggcacaagtgtctattatgataagatgccagatttctagatcaagcataaagctgtggagtgggacaataggacttaataattttaatacacttcccacgtgaactgtcaagtaataagctacatattcagacgtgactggcattgagtcatcctgccattagtcaaatgtatgagacttttcccaagtcccagcaacaccaaatttgagaaatcgtataaaagaaaaatgaaaaagtaaatacgtctaagaaatggggaaatcaataaaaaatgtactagcaccaggggcggtggctcacgcctgtaatcccagcactttgggaggccgaggcaggtggatcacctgaggtcaggagtttgagaccagcctatccaacatagtgaaacccttctctactaaaaatacaaaaattaggtcggtgtgagggtgcacgcctgtaatcccagctgaactcaagaggctggggcaagagaattgcttgaacccaggaggtggaggttgcagtgagttgaggtggaggtgcaccactgcactccagcctgggcgacagagtgagactccatctccaaaaccgtgttagcttttatcaggaaaggccattaaattttcttcaatattacctacatcaatttgacatcaaactataagaacacaatatgtgagatgttttgaaattaatgaaatgaatcttctctttgagacgagtttgtgcacgctatgaagtccattaaatattttctgggaagagttcccagttaaaactactttctaaagtacccaagcacactatatagatacatcaagtaggtttattaatgtcagtatttcggtgaaaattgggaaggccactattctgagtagagaggtgtttgttttctacttgaagactatgaaggatattctgcactactgggcctatttctgaaattgtatctagctgcaagttactcattaatttaattaacaaatatttattagcaaccaaattgtggcaggaactgtgcctagaggtagaaatacattacgctcttgtttccagagaggaaaatgagtaatgttctaaaatgtaaatcttatgtttctctttcctcttgctgtaaatgatgtctaagccatttcggtggtgcctgttcttaatcctttaataaattattttgaatgattttttaaaaggcagtgtgattgtgaggtgagtttagtacaaattaaaaaatgtcacatcagttgcaaacagacagcacataattatgagctaaacactgtttcagaaacagtagtgacaataaataggattcggtataattagtcctcctgggacagatctcttcctctgttctttgccatatattttaataatgagattagccatctaatgccaatataaccagactgtagtattaatacacagaaaaattattgctagtaacagaagatttaaagacatgagggtgatccggattatatgcctgcaggttaaaaaaaaaaaatgtttcttaaactctctttatcaatatccttttcgtgagccactgaattcttttgtttttctgatcatatgaataacccgtcttaagtatgaatattgtgacaatagtaatagcaattactttaagagaatatgtttctatagagataacagaggggtttttccctaccattcctgtatgaaggtttctgtgtttttaattaaaattttaagaaattcatctttgtcttagcataataaaataaacctcactagacaatcaggacaccttgttattcttagatacattattatagctcaagaaataacaaatgttaagcctggaggatttgtattttggccaaaagttgtgagggcaattatttatttatttgagtgaaatatgcaggaatcatatatcaaaaggagggaggtcttttttttaacctcaacaaaaatataaaagtatagggaactgttatctatgtgaacccagcaaatctgagacaggtctcagttaatttagaaagtttattttgccctggttgaggatgcacctgtgacacggcctcaggaagtcctgatgacatgtgcccaaagtggttggggcacagcttagtgttatgcatttttagggagacatgaggcatcagtcaatacatataagaagtacattggtttggtctggaaaggcgagacagcttgaaacaaaaagcaggaagactcgaagtggggaggggccttctaggtcagagataggtgagatgaacagttgcattcttttgagtttctgattagcctctccagggtagacaatcagggtgattggctctaagcagttcccagctagacttttccctttagcttagtgatttgggggccccaagaattattttctttttacacctgtgttttttctttcttaactaaaaatagtatttgtttctgagggatagagataactaccattttatttggtatgatttatttgcctaccgtccaacaaagaaggtaatctgattttgttttcatttccaagcatgattcctagagatgtgtttaggtggccaaatcaatgaagcagaaccctgcaaattcatttattgggagatatcctaaggtcttcctgaattatctgatgttcccaggctttgcttatccaataggcattaggaagaaaaggcttgtgtttatgtagatgcacacaaaatgcgcatctcagcttacataaacagtgaaggggtttcccaggtctcattatccctggaggagctgaggcctggggagtcctcagagcctcctttgctactctgttattgtggcaggccaaatctcactaatgcaggcctccgtaacagctgtttccgtactgactgagtggttcagttaaatactaaaagctaaaaaaaagccagcgcccttatacagaggctggaatgtaacaaaagcccaccaagagttttgcctaggcctttcctggcaaaaccaaggaattcttaacaggacccatttaggattaacaagttttactgggagtctgaagaaactctacaggcctccaagaacaagtttactggaggtctgcaggaactcctcaaacctccctgatttagcaggagacaagataagagtaatcaccccagcacctagacccatttagattaagtaaatttactgagactccagaggaaggtcttcaggactcagaccttagttatggattaaagaagttaatcacttctgtcatgagatgaatgcacacttacacgtagacatacagcttagaaggcatataagttctggaaactttgtaattttgagttggtctggcactaatttccaggccatctccctgtaaaaggttacaaaaataaaaactctcttcctcccagttcatctgcatctcgttattgggctgtgaggtatagtagcccaaccctcagttcagtccgggaacattattatcaaactctggggattttcaggataagttaggaatatattttgaaggagaatggcagtattaaatgagatcagcaattgaaaacatgtgaatacattcaccatttaattacccatctcaatagaagataaggatgaatttagcactagaaaccatgaatgtcacaaaagcctaactttaataccttgaatcactttccagtaatcctaatcctttatccacatggatagaggacattcctatcttgctctttcttctccccacacattagcttaataattagctaaataatttcatgcattagctaaggaataatggaactccagaaacctaggacagtaattgagagactgaacaagctaaatctgaaccttctgcacaattaaaggagctgatgttagcatggcccacagaatattacctgcacttgtaaaaactagaaagtcaggcaagtactcctggaacagactgtcttttctaaccatgcacttatttctttgtttttaactttgtttttgtttgtttgtttttgagacggagtctcgtcctgtcgcccaggctgtagtgcagtggtggaatctcaggtcactgcaagctccgcctcccaggttcaaacaattctcctgcctcagcctcccgagtagctgggactacaggcgcccaccaccatgccttgctaatttttgtatttttagtagagatggggtttcaccatgttggccaggctggtctggaactcctgacctcgtgacctgcccgcctcggcctcccaaagtgctgggattacaggcgtgagccacggcgcctggcctgtttttaacttcgtaagttgctttgtagaactatcttaaacttggtctattttagattctccttgaagggccagatcacaaagtgattaggagaaggaggctctggagccaagacagtgagactaacccattcttcaaatctaacactaactagctgtgtaaccattgggccagggatgtagcctatgtaaccacaatctcctttgtgcttcatgcctcaccaataaggtggggagagctgctatgactctgtcatagggctgagacgaagatttgatgagttaccagcaaaaagcatttaatatactgtctcattcagaagcagtcaatacacattgaactcttattacttagaggaaagaaaggggtcgatgatttatagataaggcctgagtgaaagaaataaatgtgtattgagtatcagcaatggactacgcatcattctgggtaactatcactgaacacatttaatctgcaaatactatctgaaagatactgccatctgaattgcataggtgggaaaagtcaaggcttttgtgcttatttttaaatgtatgttaacatgaataattaattggccgtgcactggtcgcacgcctgtaatcctagcactttgggaggccaaggcgggcagatcacgaggtcaggagatggagaccatcctggctaacatggcgaaaccccgtctctactaaaaatacaaaaaaattagctgagcatggtggcacgtgcctgtagtcccagctactcaggagactgaggcaggagaatcacttgaacccaggaggcggaggttgcagtgagccaagatcacgccactgcactccagcctgggagacagggcgagattccatctcaaagaataataataataataattagtgggaatatatgctgtttgttgtgataggagaagaaaaggggagatccagatgttggtcatcagaaatgacctgcatcttctctaaattgaaatttagcttgaagtagtaatgccaaggccagcctggggccatggcatcctggtgtacctgcttgttggtgacagtccttttaggacaaaatatcttacaaaaacattcatagatgactaactggaaaaaaagaagttatgatgaaaagcaattcttactgtttttgttttttgttttttgttttttttaattaaaagacaggcagttattctctttcccaggcttgagtacagtcgtgcaatcagggctcactacagcctcaacctcctgggttcaaataatcctcctgaccaagcttcccaagtagctggaactgcaggcatgtgtcactgcacctagctaatttttaaaattttcttgtagagacaggttcttgtaatgttgtccaggctggtctcaaactcttggctgcaagtgatcctcctgcctcagactcccaaagcaatccttacttttttaattgaagtgctttttttttttcttatttaaactcttaaaaattcatcccattttcttcaaaacaataaatcctttacaagggagaaaaatgaaatagagcaactaagaaagcatccatgaaggccaggaaggaacatcatggttaaatgcgattagtcacagccccttctgtctccagtcttggatgaataatggtaacagaactagagagatttctaagaccttggtgcttaataacaagcaagcatcgagggtggttgtgcaagatcctgatcacacaactctgcatatcaaatatccttcacaatcaacaagagtcagcctttaatctctgatgttttcaaatgttctttttttttaattcacatgtataacctatcctcttttcaatatatagagatatagcttatcagtcattacctcttttactacttttcttctgagatttaaaaggtcatcctctgatttgtaaattcaaccagatttcacagttcagatgagagttgtaataagttgccaagaactgttgcaagctgtgatggctgtctttctggggattatagagaagcacatttcttttaggaaaaaagaaggcagatgagcccaagttgttttatttttattgtgtatatgtatttgttttctcaagtacagtagcatggcctctgtggcaggcattcaccaagcaaatacagagcaccctctgggtcaagcactgtgttattggggttccaaataaagaaaaaagaccaaatccagccctgtggatctcacattaaagaggggagtaagaatcatagataatttaatgagttaggtacattaatggggatttgcacagtatttcataggagcacagaaaaagggtacctcgttccacctgagatggcagggagatggctcctaagttaactaagcaaaaggggaaggagaggcacatcccataggatatggataacacaacaaaagctccattaccacccgccccaccaccacacacaccatctctggaataaattttgtaccttccaactggttttcagggtactcatgacacatgggttaataatagctaggtttgcccaaatgaccaaaattctattcccaacatgaattttcacaactggtttttttgtttgtttgttttaatgaagaagaaatgttgtgtttttggaaatcatcttacaaaatcatgtagtggaatgcatatagtgatgaaattgttgaagaccagggaatctttgtccttagtttttattaggatggatgttttcaggtaaaactaaaataaaaatgaaatggaaccaattagaaagaaaataggagcacttaagacgaaatgtaattgttgctgaaagaattagaatctgatagcttagaaagaacttaattaaatttcagagtaaaataaatacagtttagcaatggcctttctcctagaaaaatataatgtctcttacagttcagttactccttggcttacaaaatagtggttaaatttcctgtttttctcattttgatttcgtatgttacatgttactggtgatgggattatctgtgtgacattacctctggtcttcaaaatgtacacgtagcaatgtagtctcacatatgccccttgggtgcgaaaagagaaggacctaacttaacctgacagacctcaaatctgttctctttctatagcagagtactcctatttaaaaagaaaatgttgagtaaggaggacagtcatcatatatgtcgagaatgttaaatgctcttgtggaagtgaaaagcagccgatctaagtaattacccattaagaaaggagtaggagaaatgtttagaaggcagacctgcaaaaaggtgactcacagtacgttcacatgaccggatgcattagtggaacctctaacccatcgccaatggaagaagcagtgttttgcacaaacttgaaaaagagtttttcattttcctcccacagcctcgtcacgtgttcaatatgctaaagaagtatgtccgcgcagaacagaaggacagacagcacaccctaaagcatttcgagcatgtgcgcatggtggatcccaagaaagccgctcagatccggtcccaggtaagcgtggggtataatcatcttctgcagctttgacaatccaggattcttgcttcttgggttggtgacaggatcccacgcattctccgagcacctataggtgttttccctatggcaagagctctttaacttctggtaaattctaaaagcttgtcttagagcaatatgtggtttggcattttctgagttatgaaaataacaaatgtaaaaatcttagtctactgctaactgattgctaaggaactgattaaaaccaatgactaaaatgagaaaaacaaaagttgtataaactaaaatcttgaaaactggttcaactgaagtatggcaggcaatcataaacctactggaatgttgagatttcatgtgagcctaaatgaagcccagtaataatgtattttatactccccggttcccaaaggctgaaaactgggatctaccttaggaaatgtgaaattttacattttcttgaatgaaagagttaaatatatatagcatgaaatagccaatcaaattgaaatacgttgttttctagggggaaatttgcaaagaaatgtatttaggcatgagggtcctgttaagagagcctcagtattaggaatcagaggtggcagaggtagcctttttaattggctgttataagcatacaagataatggtaagtttcaagatcaagtcttaaacctgagctcaaaaagttagagaacagaaataggagaacaagaaaaataaagttgccctttcagttcaacctttttaacagtagcagtgttttgtcagttttcttttggaagtttgtatctacctgcagtgcttggtaagaaaaataacctgggcgacagagcgagactccgtctcaaaaaaaaaagaaaaaaagaaagaaaaagaaccattcctacccccagacattgttgacctggagttgtcatcctttgatgcaggttatgacacacctccgtgtgatttatgagcgcatgaatcagtctctctccctgctctacaacgtgcctgcagtggccgaggagattcaggatgaagttggtaagtaagctgttcttttgatgctgcacatggacatgtattttcccccagaggaaaattgaggaagtgagttatctgtttgaggaatatggaagttaatagaacagcttgccttttacgatgaaactgtcaggctggaactagcttactagccttagcaattgaatcagttcttacctctccatacttgtaagactggaggaatgtcgcctgacttagggtatagttttgtaataattggacacttgttattgaattatacgtggcagcattttttctaatttgcccaatcttgttatggctctcaaattatgatgctttggtactttacaattaatggggaaaaaaactcattcttcatcttttgagtgtcacgattgttccatcttacaaatgaaaaagctcaaacttaaaatttgagtaacttactggcctgtgtcacatgcattataagtagcacagccaaaacacataactgtgacttgtgactttgaggttattgttatattcagtaagtcacaattctctttgatggctgagcagggaagccatgagtgttctctgaaccacatcattgtttaaacttaaaagatagtgggctattaaacttatattctgaaataattgtactctcacaagaacttggaaaaatagtacagagaggtctcatgcatccatcacccacatgcctcaccagtgacatcttacgtaactatagtccattatcaaaaccaggaaactgaccttgtgtgcccactgtcttttatgtccctagttttcctaatgactaatgatttcatttaagatctctcatttctgtttctcttggaaagagaataaaataccacatgagtctctgtcagctgccaaaatgcccataactgtttaacttacttcacaaaggtacatagatgacgattatgttggtgcatctttcaatataagcatatgtacctatactggagatttagtgtgtagtctaccaacatataagcaatatgtatctggcatatccttccccataaagaatcctaccctttgttaattgggttggaaatagatacaggttatcatctggaatcagagcacccaggatgttgtagatggatgtacccattacagtaagtccgactttgaagtgcctgaaacaccgctcaagggaacagctggccctcactttttcccattttatgccagtgttattctgctcattctttcctgatttatgtggccttgtaaatattgtttgtattgctgtgaaatatttggcatgtgtcaagtgatgatgttctgttcagtactgcacattaatggacggaatctgaaattatactttgagctacataacttgcagaagaaacttcatatgtcagggaggtgcagtgtcccagaactttgggaggccaaggtgagcagatcacctgaggccaggagttcgaaaccagcctggccaacatggtgaaaccccctctctaatttaaaaaagaagagaaaaaaagcaacttcatagtgtgccaagcttttgttcagaaggagcaactcagtgttgagcaagaatttatgaagatagtggaggtggagtttttagtctacaccatgaattgagaacagagatctccaattaatttttcactgtatcaagtttctttagcaaacaaatatacttttcaggtatacttggagaatagacatcagtaaggaacctttaaaatactatgtattaaataagtgtaaagaagttctccaaaaagttgtagaaggtacaaaatgaaataatttatcagtcttaatgaactgaagctaaaatcttctagaaaacatggtttgtttgtttgtttgtttgttttttacagctatcttaagcctgttttcacatgtgacttcagttgaagtggcataggtaataactatagggaaataagccattacaaaggactaaaaagttgatgaccaatattccaccctcacccagcaattattgttgactctttataattaaattattagaactttttatttggcactatactactgaaaacattagccactaattagtcacacttccacagaacagatggtggttcagatatcttgaatattacgaaatgcccaagaatagggcagcacaataaacttcaaatctcagtaccagggaggatatttagataactagtatcatggaatctttttctgtaaaaagaaaaaaaaaaacagccattaggttggattaagaacatattagggggtgcagcacaccaacatggcacatgtatacatatgtaacagacctgcacgttgtgcacatgtaccctcaaacttaaagtataataaaaataaagaacatattacgtatgtgctcttaatgtgtgtgtgtgtgtgtgtgtgtgtgtgtgtgtgtatgtatgtaatatgctctcaatccacccattagttgggtttttttaagtaatgacatatatatcattctaaatataccagatgccacattctgaaagataatcttttttaaaaacctttcatttggaatcctgggtgcttccatttttaaatgactgttctctatagaaagagaagtttgcaataacgaaccctgtacactatctgagctgctagtgtcaaagctacagaagtggtttgctggggagaatagcttttctgggttgaacctagttgtcatctatagtcctttttcatttgaaggaacatttaaaacaatacgtccctttttagtaggaatatagttgaaacttcaagattggccaggggtgctaattgcttaagccaaatgttattagaggttcctcatgttattctttttacttttgtatgtgtttaaaatttctcataataaaaagtgttgcttttagcttactttctaaataggttcttcatagattttttttccaggttatgtcttgtagtcgttctaatattctctgattaaatgctttgtcattagtctgagttgcatttatttgctatttctgtatataatcaaattttagatttggagtcagttcagtacaaatagcatactaaaattcagagacactggcaaaaggagaaaattttaaagtccctaaaaatgcatgccttttgtatagaagtttgtgcttataaatacaagcaattaggatgtgcttaatgcagtcaaacatctgtagagagatacaatggtttaattaaataatggtaacagttgctttatggataagaggttttcaccagtctggggaactgccagtatctttagtgggagaggtatatctgcttcagtaaattatgcttccaattagaattctcttttatgggtgaaaatgaggaagaatggagtcatgctgagaagaaggaatgctatcggtgaaggggaaaattgacattaaatttgtgagcagtaaactgtgaccagagcatagggttcatcatgcttgtgagttctggccctggccttgtatcttccattgtgcttccctgaggcatcctgtctgttcatgctactttcccactaacttcagtgaatcccaaattcatgggtctagccacagccagcgtactgaatcccagtgccatattccagaccccaaatatcccatgtgcctctgaacctgcaatcaatgtgtataacactcatgtccttctggaaatttacttgttttacacactctattctgagttctcttggttggcctaaactatccatgatgccttcctctccctcacccattatttcttattagttgcaagttctgtatatttggccttctgtgttcatgtgaaatctctgcacatcccctacttacctgagatcctgtcctctcatcagtgtcattagactcccagccagtcaccctacctcttatctcacattggccccctcccacttcaattcctccttttcggaactatgcaagttcccttaaaaacaaaagacaaaacaaaaaaaacagctgcaggccggcggcagtggatcacctgaggtcaggagttcaagaccagcgtggccaacatggtgaaaccccatctctactaaaaatagaaagattagccaggcatggtggcaggcacctgtaattcccagttactcaggaggctgaggcaggagaatcacttgaactcgggaggcagaggttgcagtgagccaagattgcactattgcactccagcctgggcgtcaagagcaaaactccgtctccaaaaaaaaaaaaaaagaaaaaaaaaaagctgcttgtggtttttccttgcttgaaaagttgcacctttcaagattcaagtaaaatgcccaagtcctataaaccctttctaatttgcatagagaacggagaaaagagctggcatttgagtgacaaccatgtaaccaactaatgagtgcctctttgtgataatgctgatggtcacattctttctttatgaatgttccccgttgaggtacaggaccgccatatagagatgtggcagtggcaggtggtttagggtaagagtggagactgataattttattctacatcccactcaaggagccaagccctctggcattgtgcacacccactggaagtgggctgttcttgcatttcacacaaaggcagcatatgggctagtgaagatactcggaaattcagtgatagcatccccagtttacagttgaagaaattgaactttgaacctaagagagtttgccaacttgcccagcccagatagtaaagtgatgaaagtggggtggaagccaagacctgccagaagtccaaaatctgtgttctttctgctgcctattttcctctctgaagtggaattttcccctacttaacctcaatgtgaaagcactgggtatccacctccaataccatactctaacttggagtaaattatttgtttatatctctactaaccctccatcctgtgaactcttccagatatatgttggtcatccttgcctcctcaagatccagcaaggaccctggtactttttagatattagtaattataaatataaggttgaagccagtccccaggataaaaaggcagatgctccttaacttggactgatgaagtgggctcctccgtaaccctaaagacctgaccaaaactccttccttgacatctagcgtaagcaccacacaaaacaaatttctttcctaggccacagcatcctctaaagctgtgattgatcaagctaactaaatggatgtggttggccaagataacaaagcataaatcagggttctgaggacctttattaataaaattttacaacatggtccttctttgtaccatgaccctctgctatttggtcatctacttgatttaattgtgctgtcctgtttgaccgccaaccacagtctgaagctattcccatgacaaataagtgtgaattttcaagtgtcctgttgtgttataaaaggcccgtgttttattttataatttcatatttttttcattcaattttaattattatgtgcaagttcccaggctcagtcatttattaatgtttttattttttaaaaagttattttcaggcagattatgaagatttcttgcaaagaatggcctcaggcattgtttgtatagagataaaatctcctcttttaaatcactatgtaggtcttcattaatattttttcattcaacaaacgatggaatcattatttcagtgaaactatggctcctcttcagtgttcatattctgctttaattatttattaatccttcaaaagggcagaatcccttcatcctttcaacctttgctttgtcaaattgttacttaaaaatgattggtgttttctttgtcctttgtaatcttccttaaatctctgctaaaaggattctattctactctttgtattggcactgaggttatttatcaaagtgtgcttctctttgcagctacctcaaggctaaaaatgtagctcttttcagagatggctgttttacagaatgctataataaccaatttatgagaaaggcagtaggaaataaagagggaacaaaggcataattgtttcatacccattttttttcttctagcattcaaaattaataaaaacatgaattattataaaccagatgcgggaaagatctctggctgaataaatccatagtgaatggggcaggattgaaagatatggcggggaatcaagaaattcgcaataatgaaaggatgcttattttttattacaattttactgtggcctcttgataaaatgttccactcttcaggaaaaatgcagcatggttatttcaaagacagtgtttccatattctgtttctaataagcctgttgatttgggggtttagtgggtccaaagtagactaggtttaaaatagaatatttatagcacttcccagcccaacaaaatagaaatttaatgttattgagaatttcaagtatccttatgtgtaattgttagtcaaggatgaacatcaaaaaaaaaaaatcataacagcaaatagagagctgtcactttgttcttataagaacataggtgtgactttgtttttcataagaaatgacttttaaatgtatatagatttaatggtttacagctgacttaagtatttggacataagaactttttttttttttttttttttgagatggagtcttgctcagtcacccaggctggagtgcagtggcgtgatctcggctcactgcaacctccgcctcccgggttcaagtgattctcctgcctcagcctcccaagtagctgagactacagacgtgtgccaccacacctggctaatttttttgtatttttagtagagacagggtttcaccatgttggccaagctggtctcgaactcctgatctcaggtggtctgcccatcttggccccccaaaatgctgggaatacaggcgtgagcccccacatctggccaagaacatttatacatattatcaacaaccaaagccttgttcccccattggtttcataatagtctcagagctccttattcatattttccctagtgttattaagtaacagacatgaggcctgtaagtttagctgcctgtgtctaaatgtatatctttgacccaagacaatttctctttcaaaatagaaccactcatttataaatgaaaatgctttgtcaaatgaatggcaaagtacggtatactattaagacagcctcctagttttctgacatttggactgccatgttgaaatgtctccacacagcaagatacaaatgtgtgaatgccagtacacttcataccttaggtccccaactggtctgtctgcagacttgaggttacagacctgcaggtgtcgaactcaccccatagtggtggttagtagagtgctttgtatacgtttagctctctatgccttttttggttgtgatattaggtaagctctctttttcttgctttggagcttaattatggaatctgtaaatatagtgcatatgtcatccagatgatctgtggaagtcattgataatgacctttaaaaattcacatgtaatacagcatccgttttcctgaatgatttttatagttttaccattggcaaacagatactttcttttatgtatttctactccataattttaggaaaaagtaaatccttttagctacattaaaaagaatacactttctaggaataatgaatgtaaaaaaagtttccttttttaaaaaaatattgcgctctctaccattctggcagacaaattgttgaccttaatatgtataattcagtgcagtatattgatcttgtttattgtgctccaaatggacgctggcagaaatttgaggaattaaatatcaaccacagtgttttcttcatgcgattgcaatggtttgttatggattattttgttcagttcaaataaatgatgtacgttcagattctttgcccaattttttaattgggttgtttaccttactttcttaattttatttttatttttatttttatttttatttttggagacagagtcccgctctgtcacccgggctgaagtgaagcggcatgatctcagttcactgcaacctccgccttacggattcaagcgattctcgtgcctcagcctccccagtagttgggattacaggcacatgccaccacatccagctaatttttgtatttttagtagagacagggttttaccatgtttcccaggctggtctcaaactcctgagctcaggcaacctgcccacctcggccttccaaagtgctaggattacaggcgtgagccactgcactcggcctgctgttattattgagttgtaagaatttttatatattctggatactattaaattcttatcaaatacattatttggaaatattttacccattctgtaggttgtattttcacttccttaataggatccttttgacacacaaaaattttcaatttagaagtctattttatcagttttttcttttgtggcagttactatggtatggtatctaggaaaccattgtccgaaacaaggttacaacgatttatacctgttaccttctaagagttttgtagttttagctcttacagttaaatctttgattcattttaattttcatatatggtgtgaggtagaggtttgactttattcttttgcatataaatatccagtgtcccagcaccatttgttgaaaaagactattcttgccaggtgcagtggctcatgcctgtaattccagcattttgggaggccaaggtgggcagatgacttgagcccagaagttcaagaccagaatgggaaacatggcaagaccacatttctacaaaaaaattatccaggcatgataacatctatttgtagtcccagctactcaggaggctgtggtgggaggatctcctgagcctggggtggctgaggctgcagtgagccttgatcacgccacctgggcaatagagcaagaccctgtctcaaaaaaaggaagaaaaagactattatttcccccattgaatggtcttggcactattacacaaaatcaattgtccatagataatatgggtttatttcttaattcttagttcttttctttgatctgtgtgcctgtgcttactgtagtaccacactgttttgattattgtagctttgtagtaaattttgaaatcagcaagtgtgagtccgttatctttgttcttctttttcaatattactttgagtatccggagtctcttgcattacaacatgaattttaagatcttcctcaccccctgcccccactaccatttctgcaaaaaaaaaaaaaaaaaaaaaagtgcggattgcattggatctgtagatcattttggggaatatttatatataatgttaatgaggttttaaacaacacttttatctactagaactgatatttgcctcgaaatgattccaccttgagccccattcaggaacgttagtattttagaagtagcaagagaactgatttagcatgctatcatcttttactccaaattttggtgagattccagagaaattatttgtgagcttttccttaagccatgatgactgacatgtcagtagtttttgtctgtttttatgccattcttttatttttgtgcatgtgtgggcacctcaaccaaatggatggagcctgaggcatggtctcccacgccaaagtctgccgtttcttttgatgatccaatgcagttccaaagctattttctcaactcaccagctcgtttgtatggccctgtaatttgaaacaaaatctaaaaagaaatccaaattaaaatgattgggaagtgaagtcagaccacagtggtggctgtggaactacttcctggcatggaacactagagcagatgtgtcctgctttttttgtagagtcttgggaacaaccaatgattttagactggaacaagggctggttattctgtttttcacaagcatctgccttcaaggttcattttttaaaagaggaggggaaaaaaatcagtgatgtttgccaccctgagtatggagatgaatccaaattgagattaattttgaaatatgtttcccgaattttgagattaattttgaaatatgtttccacaaacactaactgggaatgacatgagtttgtttcatgtgagacggagtttggaagacatgttaatttgcttgttggtgttcaactcagaaacaaattttgcatgtattttctgagtaagtgccattattagttaacagttttcctgccgtatgcactatgggctgctttagaaagtaaatcatagaaggttagttataatatctcatcaaaaatagtggatccatctattaaccggttccaagttatgagacgtgtccaaaggaatgttgacttggtgtgcacctaaacactatttgtgaagaggctttggacttcgagcatgaaacggggtcagagggtcaaggccagggcgttacttaatttcagctcctgttgatggattcattgacttcagatagtgcgtttaaaaaagcctgtttaatgtgtttgtcttttgataattattatgtatttacatatgctcctaaaagcatgagttaaatcttatttctttgaaacagtgcttggcaacaacttgtattgtcttgtacatgccttttgtgtctttgcttttggttgggggggggcattgaaatttgtctgcccatcccctgagggcagatactgaggtgtggacctatgtcttcagcttcctgtatagcattgaagttgctatagctgcatgttctctaaaatttttatacatgcgatttaattgttaaagcttatgatttttaagtatagtattctgatagcaaatagattttgtcaaataaaaactaactttatcatcaccactgagatatcactaggtatatggcttagttctcagtcaccacttttatttgtaaggaagtcttagaagttttcacaagtgtatatgtgatagactgggcacagtggctcacgcctgtaatcccagcactttgggaggccgagtcaggcaggagttcgagaccagcctggccaacatggcaaaaccctgtctctactaaaaataaaaaaattagccgggcatggtggcacatgcctgtaatcccagctactcgggaggctgaggttggagaattgaacctaggaggcagaggctgtagtgagctgagatcctgccacttcaccctagccagggcaacagaacgagactccatctcaaaagagaaaaaaaaaaaaaagctgggtgcggtgctcacgcctgtaatcccagcactttgggaggccgaggtgggcagatcacctgaggtcaggagttcgagatcagcctcaacatggagaaaccccgtctctactaaaaatacaaaattatccaggcgtggtggtgcatgcctgtaatcccagctacttaggaggctgaggcaggagaattgcttgaacctgggaggcagaggttgtggtgagctgagatcgcgccattgcagtccagcctgggcaacaagagcgaaactccatctcaaaaaaaaagaagtatatatatgatgcttgctttagcagcacatatactaaaattagaatgattaaagagattaacctggcccctgcacaaggatgacatgcaaattttgtaaagtgttttatatggaactttacttacatgaggtacctagggtagtaaattcatagatacagaaagtagaatgctgattgccaggggctgagaggatgagggactgtggagttagtgtttaaagggcacagaggttcaatttggcaatattgaaaatagttcagtggggaagatggatggccgtgatgcatcgtccatcacattgcacagcatcgtgaaatatacttaataccctgagcgttacacttaaaatggttaaaacagtaagatttatgttatatatatttaccatgataggatatatatatgtatattcatatcattcgccattgtgaatagcaaggagattgaagaaataaggacacaggatcttcaataaatatgtattaaatgcttcccatgttccacattctttgtcattgccagacacgtcacaggtataagggcccaatctttgttactcaaataatttagaataatttagaatttgcttggggagactttggataaacagttaagaagctgtatccattaggtaaagggacattgcttgctgcgtctcgtagcatttggtagtctcgttagacagccgttcttactcctatcgtttgctgaaatttattagcaaaggaaagaatcttagttttcagctcgttcagccgcatgatttcataggctcaggaaaaccatgtaatatgcccaaggtcagacgtgatgaataagactaaagactgaatctattccagtgtctctgtgtccagtgatacttacttactgctgttgccaagttaaacaaaactgggtttgcagagctgtttattcaccttcagcatcttttcattgaaaatgcggtagatagaagaaatgtccctcttttagcatttgtacctcagtaataagatgcttcccaagctcaaagactccacacccttaaatatgtaagtcagtgttaagatatttaaagagaacatgaatatcagctacattgtgcatgttgcaggatttttatattattttgtatcttctgcttagaagtcataagccagcccatgaaccatgccaacaaacataccttcttccatgtgattattgcagccagatttttcagtgcaggacaagcaaagttttctctgaaagcatgagataataattctcagccaggtcttcgccatttgcaagggatcagacataagagtttttagctctgttgatgttaatagctagagcccctgttagcagatggcatgttagtggcctgttgctgctggctattaaatcatacacattggccaggcacggtcggtcacaccagtaatcccagcactttgggaggctgaggcgcacagatcacaaggtcaggagtttgagagcagcctgaccaacatggtgaaaccccatctctactaaaaataaaaaactaggcaggcatggcggcacatgcctataatcccagctactcaggaggctgaagcaggagaatcacttgagcccgggaggcgaaggttgcagtgagccgagatcacgccactgcactccagcctgggcgacagagcgagactccgtctcaaaaataaataaataaaaatattaaaagtaaatgatacacatcatgagatcatctcccaaggcagcagagaattttgcgtatttttttcttagtttatattgttgcaacagagtaattcttcttgatcacagactttgctttttttgttgttattgtttctaagtttcacttgatcctcaaaataacctgagacagacaaaacagataggttttcccattaatctccttcatgagtctgactttgccagccaggctgatcttatatccatagccctggatgcatttatttatgttattccatctgcctataatgcccatccccaatcttggcctattacatgtgtctaacattactttgatgtgtacatgtcagtgaattaccacttaactgattgttagctttttgagagtatgtatcaaatctcatgtgcatttgtgtgtcctgaaacaaattattaggtataaagtatgtattgcaaataccatgcccagggaatatttcagagctgtggttctccaagtgtggtccttagtctagcaacatcagcatcgcctggcatcacctgggaacttgttggaaaagcacattccatgatcccacccctgacctcctgaatcagcaaagctagggatggggctgagcaatctgtattttatcaagctgtccaggtgacattgataaatgctaaactttgcgaattactgatttagagactaatcaactcattaaaaagttaataaataggtgagaatccattgtagcaccccagtcacctatgctattatcttctaaattcacattatacaaattgtatgccacaaaaatgtttaaggtgaaaacccaaaggaattgatgcattggattaattcacaaaaatttaacagctgcaattcatagaaaaaaaatgcatgcatatctgataattagttgtagattaaaaggtgaacaacttcttattattaataccaatgaaaatgtaattttttaaaaattatggccaattggtagttttttaaaaatctgttatgccttgtcatgataaggataggtgaaaaggaactttcataaactattgctaagtatatgggtgaaaccttttagactatttgggtctacctaataaattaaaatgttcagtcttttctaattttagcaccgtatttctacagatacactggcatatctgtggagaggggcacttctgcttgtcacctgatatcccttactactactaatatttttataagcattattacctttaaaatcatgttaaagggtaaatgatgtgcaacagactcagtttccccttctctgactcctgtttagtttacatctcttttctctctctcatttgggggctcaatacccttaagattatagagaaattgcagtaggtaatgttggctggaaatgctaacttgtaagaaacttgggtggaaatggtttaagccatcagcctaaacgatcagtgaaaatgtcagacattctccgctttcttcttccaagatactatactctactgtggccttagagttcttaattcctatataattctgattaaaaaggaaggagatgctcctaatataccttgctgttgtcccctcctgttcattagggtagctgatgtcagtcaaaataaagtctagaaattcttgagtactttttttttttgtaatatactgagaatgcttgaagcaaactaaccaaatttaagtgttttaaggatattaacagtaacaggagagcccctcgattttctgctaagaatcaacctgaacagtttccagactgctggttggcaatgtcagtatcatgagaaaaactgaaaaaataagaaactttagagaaaaagaggaatcagtgcaggctaggggaatgaacttggtaatccagtagtctttccctgccagcattttgattgataagctaagtgtctgctttttctcatcccttattttttggcaggaaaccagtattttgatacttgaatgccttctttctatcttaagggagaagccttcttaaacttcaagtgtgaagtagatcctttaggtataggatgaaaaattaagtgggactatttgtgaattactaaatcgcaaccattaaagaaactaatgccctaattagcctgtcttttgacagacatggcatccatatgtaagtctaatattgtatgcaaatgtgagacaggttttgctttctagatctctttgatgtgaaaggaaaagctggcttcctggcttccttcccatgttctgtatggacctgccttcatcctgctgccaacagctcctcaagggaacatgaaagtggaattaaaccctcctggttttcagattcagaatcctgggtgattaagtggcttgatcaaaatcagaaactgtgaaagtgctaaaaatggtcaaggcccaaggagttcctcatgtgtggtcaaaagcctttcagaaatcaaagtgtgtctttaaatacctggggtgcaaaaatcagatgttttttatttaaagaaaaataggtatattagagcagaactgggggccctctgtaggagcctgagtctgggtgtttactgtcgtctaaggccttgttaatgtgggcttgaggcttcggaatccacgaacaggggaagctagcgtctctcgctgactccagtcctagctcgagctttccatactgccctacgtgacttctgcacttttgtgccatcagccagtagactgagaaaagtatctggtatttgtcggtgtcttcggtttagctgctttaagtccttggatggaaaaggctgattgtcatcctgaaatcattgtctcctaatgtgtaattggggccaagtgaagcacagtaatttagaggaattctagttaaaaatacagattcttgggctctacctcagacctacagagatctgcatttttcttattcccccaggtgatcctttaaacattcagaggtttttaaaactcatgcttatatgcaataacaaaaatataaggattcttagaaacttgttatatttgtcttgaacatgggatgacagacattgtcattttcattgaaaaaaaaaatgaagcagagactcagaatgtatttagagacaactctaaatacattctggcagagcctaactactggattgcagagatcctccctgcttcccccagtccccatctataaactggccatgtgaatttctagtggtgttcacttccaaagtggtgattttataaaatattacaatgaagcattattaacctcaagaagttcagatgcatagagagtttatttgggtgtggcagcattagtggctaggttttatttatccaagataagacttcttattagctatgaaaagggattggcataaactgcttattaatgtccattaactgtatctaaagggaataaacagtataaaaggccaggcatggtggctcacacctgtaatcctagccctatgggaggctgaggcaggaggatcatttgagcccaggagtttaagaccagcctgggcaacatggggagaccctgtttctacaaaaagtcaaaaaaataataagctgggtttaggggtacacacctgtaatcccagctagtcaggaggctgtggttggaggatcacttgagcccaggagttggaggttgcagtgaggcctggcggcaccactacactccaggctgggtgacagagggacgaccttatctcaaaacaaacaaaaacaaaaaactgtataagcataagatgggcttgagtcacaaaattctgcctttcataactttcccccatttgctgtttgatttgctgtttcagaaattgtgaacctacttctctacttatagaacatttacctccctcttagattcttccctttctatcattgatactgacattctgcttaaagaattatccatttaggctctcttcaaatccaaagtgatattattttattttaataagagatgaaagggaaaattgacaaaatgtgcctggagttgtcagcattgtaaatgatggactgtaaaagcttcgtcttggaagattgtcagagagcctagtgccagctcaaaaagtgtggtctttttagagaattgacagaaatgttacaaagaaaacatgtgctgaataccaactccaggtgcgaatcctgagaagcaactcactctattctgcagtaggagatgaattttgcaggttatacagcagagcaatttaaactcccttgtttcttaaagtatatcctatagtgacttgggatggaagtcatatactatccccttttttgttccttcaaagtaaatacaccacagagctggagatgtcccagacacagggggaagctgtttggatttttcccactgcctgtaatgaagcaagatagggaggaagaacttgggaacttgcgtggcaaatggtcaagtaaagaaaaagaaaagctttttctttacttgaccatttgtcacatgtgctttcaaatcctgaactgagtcacatctgaaataaatcacttccttgtcatttccatgaaaggggcagtacaagaaattccttgcacatccctggtgagccccttgttactctcagattcagctattgccttcaggaaaaaaagaaaaagaagccgaagaaagaaagaaaacagaatcctctagaaaaagctattctgacctgtgctctttcttttgtctgagtgtgactagataaatgcattagtctgctagggctgccataacaaaataccaaaataccacagactgaatccttcaacaacagaaattatttttctcatgcttctggaggctggaagtccaagatcaaggtaccagcaggtcggtttctgaggaggcctctcttccttgatttacaaatggccacctacgcatcatgtcctcacatggtctttctcagagagaaagagaggtgtctcttcctcttcttcttttgttttgttgagacagagtttcgctcttgttgcccaggctggagtgcaatggcacgatcttggctcactgcaacctccacctcctgggttcaagcgattctcgtgcctcagcctcccgagtagctgagattacaggcatgcctggctaattttgtatttttagtagagacagggtttctccatgttggtcaggctggtctcgaactctcgacctcaggtgatccacctgccttgccctcccaaagttctgggattacaggcgtgagccccgcacccggcctcctccttttcttataaggacacctgtcctattggatcagagtcacacccccatgacctcatttaaccttaattatctctttaaaggtctgatctccaaaggtcccttgagggttagggctttgatacatgaattttcaggggcacacagttcgatccatagcagttggcttattcatactttgggtagatcctcttcatcgttcctcagctactgtctatttagtgcacagcttctttatcctaaagctagtcaggggaggcatggaaggtattatttctcctgtttctgcacctaaggcattaaaacgaggttgtggtctggcagcctaaactcggccttgatgaacttcaaatcctagacctccttggtatgtgaagtgcatacacttgtatggagggatttgacaggttttttttttttttttttttttgagacagagtctcactctgttgcccaggctggaatgcagtggcacgatctcggctcactacagcctccgcctcccggtttcaaatgattctcctgcctcagcctcctgagtagctgggattataggcgcgcaccaccacacccagctaatttttgtatttttagtagagacggggtttcagtatgttgatcgggctggtctcgaattcctgaccttgtaatccactcgcctcggcctcgcaaagtgttgggattacaggtgtgagccaccgcgcccagcccagatttttttaaattagtttttagtgtatccacactgttaaagcaggtggatactgctggatagtataacaaagtatagtgtgacaaacccataaccaagcattgttagctatattttctcatgtcttgagccaaaaggtcacagttaacctaatgttgctactaaacactcataccataaaacattctattccagtcttccagattttacacaagaataaaatgaaaacttttagactactggagatttttttttaaatacacaatttgttgaatgtgaacgctaaattgaaattgacatgctaagttttatagattacttcagctgccctgacttcagtaaatttagttgtgacacaggtacaacagctgacttctttctggcattagaggtggtgatgtttcgtcactctggagttagtaaaacctgaaacccgccaggcatttgacacacagtttgctgccagggacagctcagcttctggcttattggagaggaaatgacctaacctctgtgtttacaaagtgtttgaaactgaggcccttccacttccttgctgagtgtaagggttgacctggcatccaaaatccccatgatcttctcaggataagtcatgcagccattggtggtcaagaaaggatttgttccctgtggaagggcattggaagaggaacagagctgaaacacacgggtgttcagagggaaaacatctctgcacttaagagggctagattagactattagactattatcatagagctcgtgattcatctcctttgtttaattccagccttgagtaaaggactcactaagaaaccacattcggccgggtgttgtggctcacgcctgtaatcccaacactttgggagaccgaggcagatggatcacaaggtcaggagttcaagaccagcctggccaatatggtgaaaccccgtctcaactaaaaatacaaaaattagtcggggatggttgcgggcgcctgtagtctcagctactcgggaggctgaggcaggagaattgcttgaacctgggaggaagaggttacagtgagccgagatcacgctactgcattccagcctggtgactggagcgagactccatctcaaaaaaaaagaaaccacattctattccagtatatttattataaccagaaattcttgtcttatcagcaaatagctaatattcacttacatgggcagtgtattagattcctagggctgctggaaccagttaccacaaaccgcatggccgaaaccaacagaaatatactctcattatctcattattctagaggttagaagtcctaaagcaaggtgttgccagggccacactgcctcttacagctctaggggagaatctgtttcatgcctttcgcttgctctagtgctgctgccagcccttgatattcctttggttggtacatgcacccctccaatctccacctctgtcttcacatggtgttactccccatgtctctgtttctgtgtcttctctaatatgattaagggcccacccttctccattgtgacctcatcttatatctgcaaagaccctgtttccaagtaaggctgtattcttaggtgtaggcattaggacttcaacatatattttgggggaaaattcaacccataatgcggttatgtttttattttccttgacttttaagaatgtgaactattgtcaaattttttcaaccactatcaaatttaaatctaagaactacatgtcttaaatttatgacctcttcattaaaaaaaaaataataacatttaattggtaccaaaacgtgaaagagtttaatgctttgcatttgcttgaggctgattaatgagtaaatgtgtcaactgtggctgttttaattagccagggttaattaatgtttaccacacttggaagatgaaaaggcatgtataaatgctctataatgtgaatcattttttaatttgttgttgaagcttatagtgtagccaagtaaggattgcttacatcatacttacaaagggaggttcattaatggatacaaatacacagtttgatagaagaagcaagacctagtatttaattatcagcaaggtgactaatttacagtaatctactgtatatttaaaaatagctaggagaacctaatttgaaagtttctagcgtaaagaagacaggctgggcacgatggcttacacctatagtcccagcacttgggaaggccgaggtgggaaaatcacttgaccccagcaattcaagactagccagggcatcatagtgagaccccatctctacaaaacaaatatttaaaaattagccaggtgtgatggtgcatgcctgtagacccagctgctctggaggctgaggtgagaagatcacttgagcccagcagttcaaggttcaagtgagctatgatcacatcactgcactccagcctgagtgacagagagagacccttcctcaaagcaaaaagaaaagaaaaacatttaagtgatggatatcccattatactgatttgatctttccaaattatatgaatatattaagttttctcatataatctgaaaatatgcacatctattatgtatcaataaaaaataaaattttaaaaatgtaaaaaacgatgttggagcactatggtacttaacgtagaggctctgacttttgaggtacattcattacctgttactgaagttgagtatgctttaatattgtatgtttagaaaaggtagttacatttttaaatctgattgtgtaagaagaaaagagtagaaatgtttggggccaagtcaataattatttagtatatcataatttgagatgaaatgtgtttttttttttcttttttagtttcaagttgaaacattttaagaacagataaggaaaggctaactgtgctgagatgaaaataacatttttaaagtaactatcttaaagaaaatacatttctagaattttgtgtaaattttcaacaaagactcagaagcctggatgaggtcttgtgccaagactggaaagtgtggggattagaaaaagtttgaagagattgttgtgagatcctctcgtatgaggcctgaagctgtacatccatggaaagcagttaccccaggcgggaaaacaggttatccattctcgagtgagtggccgggtgggaaatagtccatcatgtcgaatggatcgtactttccagcaccaagatttgtggttctctaggtgaataagatgacaccccttcacttcacttcacttcaccattgtctgcatggagtacgtatctaaaaacaaattagcaaaaaggttgggtctactttacttttcatctcctacactattttcttctttgttctcggcaggaaaagatgaagttgcattttattattatctcataggattcttattctaaaatgatttgatttaaaacccattgcactttatttggataaaaaatgcttcactctctagttcttaacaataacaccagcctgattttattacgttaagcactgcaattagacaatacaaagaatttgcagcaacaacatgttattttatcatgggtggaactgttcattgtctagcagaatttattaccagataaatcccttttggggaatctaatgtggatgtttttttcaaagcgcctgtggagttctgctagtattgggaacgtttccattttcattctgatgcttccctgtgggctgtttcagcatagaagtgagctctctgggtccatgtttccattggctccacccaatattctgaaagattgcaactcaacatgtgtaaacagaacctttctcccccatattttctcttttcgtagattaaactcaggtcaagaattagaagtttatcctccaccccgatagcatctcgccctatcccaaataccgccaccaaaatgcccactgtttttccttgggccagttcctgaaatatctttctggctgtatcactcttgtgtgcatccttatcggctatgcttttggccattttttactgctgacttgtctggttagtcttttataatctccaggcttctcctccatcctttttttacagtttacctgttcatgaagcgcaggtcacttgacccgtagaattcccataggctgggattttgctaattgcatactcatggtataggtcagtgtattcctctgccctctgtatcccacaaactgaaagcctcttggctaagctgcttcccttttcacttcccttgtaccacagcagccagaagagtcacagatcctgggcagcttgtcctctgtgcctcggtacatgcacttgtatctgctaggacaatgatctctttccctggggccccactgtaatatcactagtcacatccctaaagcccaggcttgtttctttgtcattctgtcggtatccctaccataacacttgtaatagtaattatttttatgcccatcttttcttctgaaccatgagcccttcaagtgaaaagaaattgatgaagttatttctagcactcccctggaaaaaggaaggcaggcagggagggaggggctcactagtttatgataaagtggtttgattttcttggttgcagattatttcttttaaagtgactcttttcagcttctctcactcctgtgcatcgtgaatgctctcctgaagacagacgctttccattcatttccaagccccccatgtgaagtgctttctgttgccaggcttggtttccccacacgttgttaaagaagttaaagaagcttgtgaataagctaaagcagaggagaaagaaccattgctatatctagaattgttcaccagaaagcaagttttgtgttaaagaaaacacgagtaggccactgtgcagaagtgcttacagggtttgtgtgctttttaaaatctgcataaataaacatttcaaatgagctatcatatatacaaggatgatgtgctgtctgtgggaaaaggacccaatcctgtgttgtgattttacatatatatatatatataatttgtgctattacacacttgcctgatccccttataattatctgcataagtctttttaggctctttgaatgaaattcactatgtatggatgttgaaaatcatcctttctaccatgagctcatcagacttgctaaccaattctttgcatcctttgaagtataaaattccatcaattcagcatgtatcaacatgaatcaattagaatgcactttcttcacagcatggcggagtttttgctggctgccgggaggggcactgtttcccaattcattcatttgcttgggcccgccccaggatccttcttatcccggtcagatagacttctctcatgagcttgagagacggggctggtcacacaggacacggctttagggacacgactcactgaaactacaaaatgagtgctgctcttagagttgtacccacagcctgcacagctgttatggcaatgctgtgggcaagtcttgctacggcccattctcctccctcccttgtcctgttggaaggttcaggttggagctgaaattcagtccagcacgcagctggacaagccatgtctcctgtatgtgactcactccccagagaaagcatcatgtggactagtaagggcttggctttatcagaagcaaaggagaggtttacatctcttcttgctctctcttagtgggttcagagctccagcagaaaaaatgggacactgtggattgatctccagaaaaccccaaaaccagcactgaaggctccaggagattatgcctttagattgtatacaggcaccagaatgacttttgcctttataaaaatgcgtgcaagagcatgaaaactaatatttgaggaatttttttttctcactgtactttctggtcctcactgaaagcattggcagttttaaaaaatgaaatgtgatactgttatagacgtagcaaacctcacgtttcattttttccaattcattctatatctaggaacttacttagaaggagaaacaaactgtacccagaaaaaggaatgaaactggagaattcttcctcatgattcctctgtgtcctcaggcctaattatcctcattccaaagactctccattgcctcaataacttcgaaaaatttactctccttaagcatagtcataaaaattgcatagtaaagtgataaagagacgaaaataatgctgtaagaataaaaccattaaaaaaaaaccactactcttgattatttctgctgttagaattgtaaatgaattctcattccttttttctacatttttggcatgaaatttatgttactcttataattagtaaaaacattatattttattaataaaagaagactcacagtgaagtcataacatatgctgcagaggttagactcttcaagtcagatttgaagagagaatttcacgtaacaatcaccttgaaatgtcttcaggtcagccatcaaagtacacatctctcaaccagccaggcagccagtttttcctccagcatgtgaagagtgaagagatagctgtttcttggcttaaagaccatatgaaataattgacttatgtttaaaagatatgagggatcaggccgggtgcagtggctcatgcctgtaatcccagcactttgggaggccgaggcgggtggatcacaaggttagaagatcgagaccatcccggccaacatggtgaaaccctgtctctactaaaaatacaaaaactagccgggcgtagtgatgcgcgcctgtaatcccagctactcaggaggccgaggttgccatgagccgagattacgcctctgcagtccaacctggtgacagagcaagactctgtctccagttaaaaaaaaaaaaaaggcatcaaaattacattcacttctatttttatttttgtttgtagaagacatgcagtttgtatcacattaatgggcatatgatgtaatttcactataaatcgaaccagaggaagacatccaaatatgtataaattaaagctgacaatgcctacagtactaaactttttgttttagtataattggagacttagaaaagttctaaaaatatatttaaaaatttttaaaggaagttgcagacataatggccctttacacctaaatacttcactgtacgtttcctcaaaacaagaagatatgtgtgtgtgtgtttgtgtgtgtgtgttgtaatcttaatacagcatctttcagagattatttctgtagtatataaacttggtttttttgtttgtttgtttgtttgtttgtttgttttgagatggagtctcgctctgtcgcccaggctggagtgcagtggcacaatcttggctcgctgcaagctccgcctcccaggttcacaccattctcctgcctcagcctcctgagtagctgggactacaggcgcctgcaccatgcccggctaatttttgtatttttagtagagacgcgatttcacctcgttagccaggatggtgtcgatctcctgacctcgtgaaccgcccacctcagcctcccaaaatgctgggattacaggcgtgagccaccgcgcctggccataaagttgttttttagtctctactttaagttcctgacaacccaggcaggaccaagactccctaatgtagttggaaatcagatcagcacattggcacaagttctacaggtaaacgggaaaaaggagccctacaatctgcttttagatgccagggagcctggctggtctttatcttgattactgactgatgccactggtaggtctaagttctttgatctatgatgtttgaaagccaaaaggaaatgtgttttaaaggaaaagggacttcttctgtaccctcagtctaagccagacaagtgatatttcaggaaaatgtccctagcaataaggaatattttcacaaatgatgtgaagctttgtttgtgtcccttccagggcagtttgttaccataaggggacaaagcatgcttcatttaaacatgtgtggccaggaaactgttatttttaaacaaaaataaaccccgatttagacatgtagtctgagttttaactctgggagattttcaagattgatagtgtagctaaaaataactgacctaattttctggaggtcaagataaaaactggatttgtggtacagcatttactttgtgataatatgtgtataaattcttccccaagttggaaaatgtggccgcgtcatacagggctgtatctctcttgaccattgaagtgcctaggtcgctacactacaatttgacttagagttggtgaaacttctggccattcacgtagccatcgtattcatcctgagaaagggaaacctaaagacttgggagagtgttctgggaggaaagtgctattgagaatgggctgtccaagcaaagtgacaggcaggcctcacttagctagaagagggagcttttcagccctgctccaccatcaggaatctccgtgaccttggactactgctttaatctcttttatcctggcttctaaaagataccgtcgaattcattctttttcaaacctatcaaaaatttgaaatgtatgaaaaagagggtgcttgtgatgatagatgggtttatgcttccttttttttttttttttttttttttttgagacggagtctcactctgttgcccagactggagtgcagtggcgcgatctcggctcactgcaagctccgcctccggggttcacaccattctcctgcctcagcctcccgagtagctgggactacagtgccaccaccacatctggctaattttttttgtattttcagtaaagatggggtttcaccatgttagccaggatgctctcgatctcctgacctcatgattccaaagtgctgggattacaggcgtgatatgcttctttaatattagtttctaatccaagtaatatagccatgtcctctataaaatggaacttttcatggaacagtgagaaggttgcattaggaattgggatacttgggttcagatttcagttctgccacttgctagttttaagtatacttctcaggatggatgtcagtttgttcaactgtcagtgggagtagtgatcccactaaggaagattattgtggttatcaaatcagcagatgggtatgaaaaggccatgagtgcagttctcatggttatgaaggtgtcataactggcatagtcccatcacagtatggctttggcatcgcagatggctgtagcatatatgctaatcagaacatccctaccgtccttaaagatctcatgggttctctcccaaatcagctgctccaccgacctacaagtaagtccatgcttctttagtatatttactcactagtgaaggcccgtctgctaaaagtgtcttcagtaggggagagctgctcttttctgggaaacccagcaatgaagtttgtcctgtgatgccctctacacttactgacctgtttcctgagaacttcccgtaacaaatggtccagggaagaaggaagtctgtgaccagtctttcctttcctgtggctttctggttcagaaatgtgaccctgatgataagaaacttcaaggcatgactctggtgttttggcaatattcccctggcagtattgtttcttggctcacactcatctcatgccttgctttgtttgctttgtttttgagaattgtttttttgtttgttgtttgtttttggttttggcttgtgagacagagccttgctctgttgcccaggatggcgtgcagttggcacaatctcggctcactgcagcctccacctcccgggttcaagcaattctcctgcctcagcctcctgaataatggggattacaggcacacaccaccgtgcctggctaatttttgtatttttttagtagagacgggtttcaccatgttggccaggctggtcttgaactcctgacctcaagtgaaccacccacctcggcctcccaaagtgctggggttacaggcgtgagccaccacgcccagccattatgtttgtttttctttcatgaagggataaccgaggctgttgtgtggtggtgtcttggtacagctcgtggctgtggtcagtgtggtggagggtaggtcttctcagatggtaacatgcatgagagtcacctggggatcacattaacatgcagattctgattccctggatctgggtgggacctgaggttctgcatgtctaacaaactcccagagaacacccatgtagcaagagtacagacaaaaggattcaaagcgaagggactgcaagaaccatggaaccagcctcccacgattttgcggatgacgaacccgagccttggggagtttcagaggccatggagagatgaagtataataaacagcatagcagttgtatgttgagccaagaatcagacatgcacagaactgctgattggaaaattaaatctgtttctcatagccctggtgtggcaaaatgcctagctggaagtgggtgaccgcttgatttacagtgggcctcctgggtagggaaaattagtccatcccatttacagctacttccaatgcagctgtgtcaggggagagagaagaaaggacatggaagagagcgtagaggtatgatcttcagtcctttcaggcaggcacataagtaaatttttatttaaaagataagaattggtcatatgcgaatctcctgttagataagattaaaaacaaatttccattttgtggagaagttgcagataaatatttttccatgggatccaaaagaatcaaaaaggaaagaaaatagtaatagcagtggaggttcgatcctagacagaagaaaatccagcaagccgagggacttcatattctcactggtgtccaaatcagagctttttttttttttctttgtttactttaagttctgggatacatgtgctgagcatgcaggtttgttacataggtatacatgtgccttggtggtttgctgcacccatcaacccgtcatctaggttttaactccgcatgcattaggtatttgtcctaatgctctccctcccctttcaccccacccctggacaggccctggtgtatgatgtccccctccctgtgtccatgtgttctcattgttcagctcccacttatgagtgagaacatgagtgtttgggtttctggtcctatgttagtttgctgaggatgatggcctccagcttcatccatggccctgcaaaggacatgaactcaacctttttttttttccttttttttttttttttgtatttgcaaattcaaatctttttttttttttattatactttaagttttagggtacatgtgacattgtgcagcttagttacatatgtatacatgtgccatgctggcgctgcacccactaactcgtcatctagcattaggtatatctcccaatgctatccctcccccctccccccaccccaccacagtccccagagtgtgatattccccttcctgtgtccatgtgatctccattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaattgcgacactgacttccacaatggttgaactagtttacagtcccaccaacagtgtaaaagtgttcctatttctccacatcctctccagcacctgttgtttcctgactttttaatgatcgccattctaactggtgtgagatgatatctcatagtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtccattttggcttttgttgccattgcttttggtgttttggacgtgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgtttcggttactgtagccttgtagtatagtttgaagtcaggtagtgtgatgcctccagcttcgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagttggtttgtagttctcctttaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcgtatcagcttaaggagattttgggctgagacaatggggttttctagataaacaatcatgtcgtctgcaaacagggacaatttgacttcctcttttcctaattgaataccttttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacctttattgatttgcgtatattgaaccaagccttgcatcccagggatgaagcccacttgatcatggtggataagctttttgatgtgctgctggattcggtttgccagtattttattgaggatttttgcatcaatgttcatcaaggatattggtctaaaattctctttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaaccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgtgtagaggtttttgtagtattctctgatggtagtttgtatttctgtgggatcggtggtgatatcccctttatcattttttatcgtgtctatttgattctcctctttttctttattagtcttgctagcggtctatcaattttgttgatcctttcaaaaaaccagctcctggattcattgatttttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattattaatcctgagttctagtttgattgcactgtggtcggagagatagtttgttataatttctgttcttttacatttgctgaggagagttttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatgtttaggatagttagctcctcttgttgaattgatccctttaccattatgtaatggccttctttgtctcttttgatctttgttggtttaacgtctgttttatcagagactaggattgcaacccctgcctttttttgttttccatttgcttggtagatcttcctccatccttttattttgagcctgtgtgtgtctctgcacatgagatgggtttcctgaatacagcacactgatgggtcttgactctttatccaacttgccagtctgtgtcttttaattgcagaatttagtccatttacatttaaagttaatactgttatgtgtgaatttgatcctgtcattatgatgttagctggtgattttgctcattagttgatgcagtttcttcctagtcttgatggtctttacattttggcatgattttgcagcggctggtaccggttgttcctttgcatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattacgtgtcttggagttgctcttctcgaggagtatctttgtggcgttctctgtatttcctgaatctgaacgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcgtttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttctttggaggaggagaggcactctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgcagtgtgaggtgtcagtgtgcccctgctgggggtgcctcccagttaggctgctcgggggtcaggggtcagggaccacttgaggaggcagtctgccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaagcaggcctccttgagctgtggtgggctccacccagttcgagcttcccggctgctttgtttacctaagcaagcctgggcaatggcgggctcccctcccccagcctcgctgccgccttgcagtttgatctcagactgctgtgctagcaatcagcgcgattccgtgggcgtaggaccctccgagccaggtgtgggatatagtctcgtggtgcgccgtttcttaagccggtctgaaaagcgcaatattcgggtgggagtgacccgattttccaggtgcgtctgtcacccctttctttgactcagaaagggaactccctgaccccttgcgcttcccaggtgaggcaatgcctcgccctgcttcggctcgcgcacggtgcacgcacccactggcctgcgcccactgtctggcactccctagtgagatgaacccggtatctcagatggaaatgcggaaatcacccgtcttctgcgtcgctcacgctgggagctgtagaccggagctgttcctattcggccatcttggctcccacctcccgaactcatccttttttatggctgcatagtattccatggtgtatatgtgccacattttctttatccagtctatcgttgatggacattttggttggttccaagtctttgctattgtaaatagtgctacagtaaacatatgtgtgcatgtgtctttacagtagaatgatttataatcctttgggtatattcccagtaatgggattgctgggtcaaatggtatttctagttctatatccttgcagaatctcctcactgtcttccacaacggttgaactaacactctcaccaacagtgtaaaagcgtgcctatttctccgcatcctcgccagcatctgttgttgccagactttttaatgatcaccatcccaactggtgtgagatggtatctcattgtggttttgatttgcatttctctaatgaccagtgatgatgagctttttttttttttttcatatgtttgttggccacatacatgtcttgttttgagaagtgtctgttcatatcctttgcccactttttgatggggttgtttttcttttttttctggtaaatttgtttaagttccttgtagattctggatattagacctttgtcagatggatagattcagatcagagctttaacagccagactttacagggaaaaggctgagtggcacctcctttatatgaagaaaatgttcttctccaacccacttgtgttcagtggatggaagaagctgttcagtaattataactgacacttgtaacacataactgattgatttaatgcccataaattttattttctttaatcgtaagatgtgaccgttaaattcttagaagacatttggctagtggattaataattaaaagaatattggatgaattcatctgcttcctattcagcagttcttttatttataaggctatttttctcaaaatgaatgatcatgaatatctaagaaaaaacaaaatatttagctgtttgaagatgaaattattatcttttgatgttgttttctttaaagtgtttacaatgataactaagtggtagggcttcttccctctgttactctaagtatgcctcgtatacatcctcaaagcattttttttttttttttttttggagacagagtcttactcggttgcctaggctggagtgcagtggcatgatctcagctcactgcaacctctgtctcccaggtttaagcaattctcccgccttagcctcccaagtaggtgggattacaggcgtccgccaccatgcacggctaatttttgtatttttagtagagacggggtttcaccaagttagccaggctgctcttgaactcctgacctcgtgatccacccacctcggcctcccaaagtgctagattacagacgtgagccaccacgcctggccacctcgaagcatttgtaaaagagcaaggtgatggggttcattaggtgtttggtatttgaaattaaatacctctgttattgatgaagccatattttaaatattatcaccactaaactcagttaaatatttccactgttaactacaaggttcaaatgcttggatattatagaagatatttgacttcaaagataaacgctacaattttgggtcataacaaatagcttttagaaggggaaaaaataagtcttgggaggaaaataagcagtctcttagtttaatatagcggttggcaaatatagatgcttaaaagttctgaaaatccccattgcaggccatcagagtgttgtaattaagtattaaattaattcagataaaaggataatccatcagggccactaatgtagtggaagtgtggtttcggtgtgattagtctcaccatggaagtcaaagaaagtcccactcagaatgaacaatgaaagaatcatatttgtctctgggtattttgtcataggctcaattgcccagtgccagtgtgtaagccactggtaaaatcctgagcccttagtcatgtctacaggtagctggctgccttagacattttatgatgacgaaattgaattccacttctgataatggtaatccatcatgtctacctctttttttctcttaaaactacactgacggccaggcgcagtggctcccgcctcatcccagcactttgggaggccaaggcaggcagatcgcctgaggtcaggagtttgagaccagcctggccaacatggagaaactctgtctctactaaaaacataaaaactatccggtcatggtagtgtgtgcctgtaatcacagtactcgggactgaggcaggagaatcgcttgaacccaggaggcagaggttcgttgttctgaatgacatagccaggggtggttatttctaaattttctgtgttgaattaagataggaatgtggatttcttcctattttgaacaacgaccaaaaaaaaaaaacgaaggctaagtgtgtttcactctgctaaaaatgtaccttttcttgaatctgtcactttttcacttacattttctgaaaatgaatataattaaccaccatggggctcagcatgctggtggccatttggaggaacttttctaccaacagtgtaacagagaaaagagaaaagggtactacagcgtacctcaacctcccctgactgttctgtgaagtacaagtgtaagatttctcactgtgatcttttgctcctctgcctttttactgccaagggctaagatgggcacagggccctttccagctgcccctgcctgagaaatgcttatttgatgaccaaaagcaataaccattccataggactaacggtgattaagtcagcttacaaatccacaagggtggaagagactgctaaagatattggaacagacatgcttaataatgcctaatttctacagctacttttgtgataatacgagaggctgaaatagataggggctgaacatgggaaggctggtgttatgaagcccaggacttggatttcagcactggtgcttactggccattgggtcttgaagagattggttcctttctcccagcctcagtctccttgtcccatcagattaataatgcctgccttgggagaggagagtcatacaggagagggcatttgagctgggctctaaagagttcaaataacgtagatgagcagagatgggcttccaagatagcaggaatagaaaacaaaagtgtcagaatgggtatgcatggtcttttgtgggaataccccaagctatttagcctgagagagaggtgtggtgtagacagctggagctgtgagttccatggctagaaatacggggtgggcccagaccacagagggccttcagcatctggcaaaggagttggaattaattcggtagaaaatgaagacccactgaaacaaagagggagccattcttgtgtgtcaggaactaagatttcaggaaccaaacgtaaaataaaaaccagcagggagaccattgtctcagtcggtttgtgctgttatcatgataccagagactgggtaatttataaacaaacaatagaaatactacaattctggaggctgagaagcccaggatcaagccgggtgcagtggctcacgcctgtaatcccagcactttgggaagccgaggcgggcggatcacgaagtcaggagatggagaccatcctggctaacacggtgaaaccccgtctctactaaaactacaaaaaattagccgggcgtggtggcgggcgcctgtagtcccagctactcgggaggctgaggcaggagaatggcgtcaacccgggaggcggagcttgcagtgagccgagattgcgccactgcactccagcctgggcgacagagcaagactccgtctcaaaaaaaaaaaaaaaaaaaaaaggcgccttgtggctgcatcctccagaggcagcaaaaactgttctcacatggcagatgcacataaaggggcctgtgctggtttcctctagcccttttagaaggcagtagtccattcgggggcacggggtggaactgtcatgacttgatttccagaagaccccatctctcactactaccacagtggagatttaagtttcaacacatgactttgggggacattcagaccatagcaagcagtgaggagactatcgtaattatccaggcgaaaagtaatcatattcctaggggcggtgagggtggtgtggaaaagcaagcaggaaatggctgagagaattcagaaatagaatgcaaaaggatttgtcggtagtgtgagtactggacacgaagaaatacagggagtcctggatggctctgaaggattcaagcctgtgactgggagggagaatggttctgccatgattagaaaacaggaaaggtggaagggaaagccagggaccttgagtacagttgtgtacctaccaagtgcatggatcaggagggagccctaagttggtatctccagcaaactgttggaaatatacaaatttgagtgggagggagaagtcaaagctggggaagtacatttcagattcacccaaaggtaggagatctttagagtttcaagagtcgatgggatttccaaaggggagaattgtagaaagagatggaaagagatacaagaagaaaatgacagggatgaagagaggagaaaaaaagagtaaaaagagttattcagagatgtcacagggaagaagataagtactgtgtatgcgaaacagtgagaacatttccaaataaaggacatggtaagtgatagtagataccacagacccaagaacagcgtagcccctggggagttcaagagctttctcgctggcaaaggttatttcctgtcaagatgaatgtgtatgcaccaataattattagtattccagaatatcctctctttagcatagtaagtgcttaacagtcacaagcaaaagatttatataaaagaaatgctcatttaatttatttaatcagacattggctaagttattagccgctacctatggctttgtaaaacatgaaaaagttggaggaaatctaatgagggtcttttatctgtaagggaaaggtcatcatgggcatcaagtattgaattttagaaacggtgccacagtgaatagggatatattataactcagattagacttcaaaaggactaatttgcttgggacttccatcatttaaaatcacttgcaataaaactgactacatgaaaagatattaatcacaagctttaatgctattccatcaaattattttaatgggtatatttgaacagaattttaatttttcagatacattttttgtcaatagaaaagagaatttgaaagatgattgtaaaatgttacaaatcaaatttaaatcctgatcttattttcattttctctagcaataaaactaaccagtgatgtgtctgaaatatatactacagcaaactcttgacacagctatgattggaaaatgagacattttggttaatcaaatattattgttaatagtgcagtgctgtctgtcggtctctaatttgtaaaaatcagagaaaaacatggtgaatctttggtgacataagagaagactcacaaatcttcatatcctggggtcagtttttaaagcagtaattacacatgatacaagattatattctaagctctctttttccagtaagaaaagataagtcaatgatgttccataaagctgattcttgtttaatcaatttttaaagtgggggggtaggcggcactgacagcattctttggaaagggaagcaacagaggagaaaggcaggatatttggtgtctgctcacattgggaaatacggggagccaggggtggttaagtccagagaaggctggatgtctgtctgcagggctacatctggaagggcaagggaacagtttccttgttgcctcagagcataggtcatgcagcacaagaggagcatttaggaaatgcagattttttttcaaggcaagacagtgaaaactattcaagaaggtagcaaactactggccctttaatgcttttcttatccttgcaagtgtgcaaggcaagacaggagattgtctgttgtctttcagcttgaatgagattgtgcctcacttactgccgccacaccaaagcctggcgtttattcctgtgcgatcattgtatactagggacgtctaactgtgtcaggaggaaatggcagctgagcccctgtggcctttcacctctagcagtgccacgctgcagcacattggccggctgccatgctcctgcctgcagtcctgccagcagctcttgtgagctgcgactttgcataagtagcttgaatgccatgtgcctcagttttcacatctgtaaaagggagatgataatggtacctatgtcatggctctaaacgcgatcatgcacgtgaaagcagttgaagtcttgcctggcagaagtaaatggtggctgctgctgctgctgctgttgtgattgttgttactcaccaaagagatggttttgtttggtttagatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggtaagagtcccctgagccagcaagggcgttctgggaggtatatatacacatacataacgtgtgtgcaagagagagagttatcttttgtatgttcttgagtggtgaattttttttgatgtagtcataaatattttcattataattttactttaaaaagtaaatactaggagttactatgtcattaaaataatatatctgtgtaaattattctttatattttttatgctgcaaagcatgtaaactgccaattgttggaaaagacaacaactccattgtataggtggcaaaacaaaatggtaatgatttacataacatttgcaggtaaagggcctcttgtttcgcacatgtccaggtttgcattctagggaatattatccttcgagtgaacactcccggacgaaggggagccacagtgtattattgaagaggcagttcttcacaaggaaaatgtgtggcaataacattcttctaatttttattttccagttcctcttcttaatataaaatggtacattatataacaaaagtggatacataaagagcatgtactgtatatcatattattatgtttatgactttttcaaatgaggaaatggaggcaccaggagactaagttcttaagtgatgacttttggtaggaattttttagaaatgttttttaactgtgaggtatattgttccctctggaatggaagcacaaaattcaacttgtgtttatgacgtaatgacctagaatgccaccttccaaaaaagcagatagatagtgaaataaggaaaaattacagtttaccaacagagaggagttttgagggcctgcagagatgcagatttgacaggcaccaaagtagtcttcactggctacttattcttacatgaaatttcagattgaattaaatgttaaaggcaaagatagagaactacatataaataaaatttaattttgcttaagacttaatttgtgtttagaaaattaaatttaaggcagctgccaaaattaaggagcacattgctctaaatgttttttcctttggtacctcagagaagtaagattcttctctatcaacaaatttgagcagtagatggcatcctttttcacagggatttcttagcagaaacacctgttcaggcaagaatatctttcagcttcttttatctttttctacatgttcagaagtatacaattacacacaaacaccttgatttctagatacaaataacatgttttttaagaacacaacagcactttacctgattttctttatcaaagcagcaaatgttgatggagatttcatatttataatataccttataggccaggcatcgtgggtcacgcctgtaatcgcaggacttagggaggctgaggtgggcagatcgcaaggtcaggagatcgagaccatcctggctaacatggtgaaaccccgtctgtactaaaaatacaaaaaaaagttagccgggcgtggtggcgggcacctgtagtcccagctactcgggaggctgaggcaggagaatggcatgaacccgggaggcggacgtggccagtgagctgagatcacaccactgcactccagcctgggtgacagagcgagactttaaatttaaaaaaaataaataaataaagtaaaaaatatatataccttataacatgcaattagtactaaatctaaatataatattagaccttaagtgtactggacaagttttttctaaagaaccattgcagaaaatatatagactattttcacaatgtgaatcatcaccccaaatttgtttccttaatttgaaaaagggcaccttacagtaatagcaaacagcatgttactgacaatgtaaaaataattaaaactttaccatttatgaaaataattcttaatcacatagaagaaaacaattttagggacagttcattatcaaagacctggaaaactgtcctgttaaatgtattgagtgcagattgttttgtttctttacaggtagatagattttggtcattgaaggtcctcttcattcagtctctaatgagaatttttagtgaaaaatgtccgatctcattttgtaaattgaatgcacgctaaatttgctcttttactaacagcataccttgttgcatcagccttaggagaaaatctgcgtgcacacgtgtgaatgtacacacacacacatacactgtgaacccttggtaattgccaggatgtccatttgagcaaagcccttgattaagtacttctggatacttgacaaacacgcagctattacattgcctaggtctcatgaaaagagctgatattcttgttggatgattctgtttgaacagtagaatctggtataacaattttgggaggcaatagaacttgcagtgtcagagtcttgagttgcagtactcttcattatcagtcccaacattgacatatatatattgattatagcaaacaatttaaaaagccacttaagcaatttttttttttttttttttttttgagacggagtctcgctctgtcgcccaggctggctggagtgcagtggcgcgatctcagctcactgcaaactctgcctcccaggttcatgccattttcttgcttcagcctcccgagtagctgggactataggtacccgccaccacgcccggctaattttttgtatttttactagagatagggtttcaccgtgttagccaggatggtctcgatctcctgacctcgtgatccgcccgcctcagcctcccaaagtgctgggattacaggcatgagccacggcgcccggccccaattggtttttaaataaaatagacggccatcatctcataggatattaaatactaccccatacccctgaactcctgaatgatacagacccgagtttaaattccagccctgctatgtgcttctgagcaagttacttagcctctctggctgcttcctcgtctgtaaaataaggttgacaataattcctaactcagaggtatagtatgagcattaaataagaaggcataaaaaagctcttagcaaaattcctggaacgtagtaaatgtcagtggtagctttttttttttttaatggagccaggatcttattagagagactttatcagcctgtctcaagatgaatcaccttatggcctcaacaatgtatccttaaaataatgaatataataagccatataatgagatacagtcctaaagccgtctctcttctaacaccgtctcccacctctccccagaaacttgttagtctttctttgtacagacatgtgcacacacacacacatacacccaactactgaaaatatctaaaattctcaaaggatttccttttgttcttcatgcagtcctcattatcatagtttcaaatgcttaccaaaaatttgttgtttttcttaagaacaatcagtgaaatccagaggaggttctgatgcccattttttaaatttacattgaagaaaataagcatatcagagttttccaatgtgctgtgatttgccttaacaattttttattctttggttttcacatccacaaaacctaaatgaatggctaggctgaaatgaagctgttgttacagaattgtgctcacagatcgtgaaatgatctggctggaagcattagcgttgatgacatttgtgtttgttctactttttcctgactgcctgagaagggcagccacaaagagcagcatagcatgcagtgactgccagcaagtctttgtggccaacagtctgcctctttgtagataatacctagatataatatgtagataaaataatatttttaaagagacaaagcaggtcttataagacttgtatggatgtatttgcaaaatgtgaagctgccttctagtatatttttaactagctttatagaggcaatgaggaagccaatttaaatgttgaaatttagattaaataaatatttcattaaacttacaaaccagttcttgtcagcctcttatctatatgtaaaactggtgtactgctgattcctcattacctttggcctggtagagagtttgtacaaggcagcacggttaatagttgaggtttattacaaagaataccagaagtaacagactcaaaaatcccagaggtctgaccattctgtttctctcctcttacagcaaaggatttgattcaaagctactgagagcaagagaataactcatttctgcttacattttattttaactctattaaaagttaaagctaagataatgtatttcttgtttttaaattactaaacagccaatgtaagatgttttttagcacttcattgatgaagttactgtctggttaagtaaaggtcaattggaaaaattggaaagtatttgcagtggattgggaaataacacactactttgttttgttggtgtgtattcttttttttcggcaatgatatcataattgccttttaaaaaacttttaatgtctgctccctgagctacttattttttgagcattaatttatactaaatcagcttcaatcttttaaagcagattagggtttatgtcactgaaactagttttgtttaatcttcctaaaaaatagggttagggttttattattgtttttaaataatacatgcctatttaaaaaaatagaagaagaagaagaagagcggggagaggcagagaaacttataggacaatatcatttgtaagtttctttcacataagtatacgcatttgaaccctggaaaaaccatttactttgtgacacaactgaagttcagaaagaatgtgattagccccagatcacagagaaagtaagtggtgacattagcagtggcccgtgggactaccagctcctcagcctgcatttaaaccacaggtacacttaacttactgccccgagttgcatatacattttctaataacgtaactattgatgtatgtgctcaccaccacttcaaggtacgcgtttgccctcgtgcatgtggtctgttgtgttcttaactgcagttgaagcactattgggtccctcatcatcaggaaattctcacaaagtacaatgacctttcaactaactgcattttacaaggagtaatacagttactcattacaggttgctgcaaataggaaaaaaaatgaagtatagaaaaaccaaacctcattgtcgaaatgtatttgggagttgcagaaggaagtgaactatgtcttcctctaatgcactagtgaaatactagagaatagtcactctcgcatcagtagttactatggaatatttaatcataggatatttaatcagtgcagttctgtagtatctggtagggtctcaaacaggctttaaaggttacttatttgttcctcaccataattagaagatgcagatgttaacatttctgtttccatatggagaaacagccacagaagtggcgcatcccaaggccacagacattgtaaatgttgggcccaggcctgggattagatgcctcaccctccttttgactccaccatgctgccagtctctacatgagaaaggaccaaatttttatttcatccaaatatcctagtgctcccggaaatattttcttatattttggagacttggcttactgccactttttttctccctcactgtttctattaacatgtggcatccaaaatcgatttggactgagaatcccacctttgaatgcctggcctgtgtgcatcagtaagctggatggttttgctgaaattgttagaagccatttcatcgagcacaccgtgtctccttcagcacctgtgctcactttgtcttacctttttccctttacacttgccaccttaccaaagcagcttccccctgcacctacctccgtggcttcatttaccctatgaccattattaatcctaaaaacttcacttttgtccccattccttgtttcttcaaacgccagcgtaaaacaaggaagtattttctgagcatcagaagtgctttggaaaggtcagatgatggtgaggaatatcatgctgtccacactgctttctttgggtcggacccagaacacataaaaagggaaaattgtgaacaatggcaaatataaaatgaaatatcctcatttcacacgtttcagctgtatgtcatctgtcaaatggaagccagcctttttgaaaaagtgagaaaaagactgcggtttccctcttctgccctcatactaaggacaaatttgattcactcactaaatggcagattatatagtaaaactttgctctcctgataaattcatatttgcacttcccctggaaatttaacagagtccttttgtagttaattaactgtaaaataagataagattgggcagttgtaaaaggaagtatctttaaggttttctgctaggctgggaatattttatttctaatcaaaagccaagaaactatctctaaactagctcagagggaaatccaccctccccacccctcttctttgatgttgctgcgtatcctggtgagggcttttattagaaaactaaggagcaggactggcacatcaatagcgataagccatttaaagtggtgcccctcctggtcctcgatgctcgggattaactcactgtggttcttttctggctgctccttttttgtaacttgtttattgcatatgcttttttccctgctcgactatgtttgggagccacgacttaccatcttgatttgtcttgtttgctttctgtgtcccttgcttcctgtgcccagttgagcctgttgatgcccgccctgctgccgaccgaggactgaccactcgaccaggtatcagaaccgcttgacttgtgcctctccgcatcttgggcctaagctcgagcagacgttgtctcctttctgcattttaagcctctctcaattgtacttactgcagagtagaatttgaagtgaccttagaaaccaaacttttaaaaattccccttgactattccttactcttcatttcccaagttccgagtgaaatgattttttttgtttctgagctttccctttgaaacctaaaagagagcccttccaaatttgggtttttttttttcttttttctttaaaacaaacaaaacaaaacaaaaacagagacgattatatacagcctgtccttaaaaacagaagcccagatagatgtagactctcaggtgatgacttggataccagtgtgaacatctctcctttcttgtttggtgtccagatgggtaattttctaactgaactgggctcaaacttcaatcagttactgaagtagacatgatttcctgaaaataccagaattggtttctttccagagcccaaaatacatcttctgttttgtgggttgtatgtacttattctcaatgagtggctaaagtaacacaacagatgtggatgcataattttgcacataagccctttttttatgtattacttaaaaatcccattaacactgaaatagacacttctttttttacagtttcacaaacattaagaagaaacacatttttattttatgaataatgtcatagcacagcagaagcatatatgtgcctggtgtctactctatgaacaacctcacccaactgatagtagccagtgctttcagtgaatcaaaaagaggaagaaagttattgaattgacaaatttgtgtattccagggagattttaatcccaaataacacatacttttccatatttattttcttctttatcctcataatgtccccaggcgatagtcaaagaacagggaattaactttctttgaagatattaatacacagaggtcaacctttgctgcctggttcagatacagtcagcagcagaccaggagacccaccctgtccctcacacttccaccacaggctcgagccatgactgcctccaagcacggtcactgatgaagactgagagtctgcctgtggcatcttcatgcctttatgctgtgattaacagtggcagcagagacagtagtgtgacacgtcttgacagctggtctcgttgatttatgaatttctgtctgtaggcttttaaggggaacttaaattatagtgagtcagagacagtttcagttcttctaatgtcctccttattgtcaatgtcatgtaagggaatctcaaggagccaggagttgacattcctgttctgctcagccaacttgtaaggcctcgggctgagggtcagttcagttctaattgcaaccacagccagctcaggttggtcatttgccttgggacttttttcatggtgcttctctttaaaagacatgctcttcatctacaagcataaaatgtaacttagaaagcgctcattcgactcattcaattttatcaaatttctacattgggccaggagagcctatatgttactattgaaacatccaggaacaggtgacactaccagtcaatgtttttttcttttttaaaaaaattgttttttgattttttttttttttttttgagatggagtctcgctgtgtcccccaggctggagtggagtggcacgatctcaactcactgcaacctctgcctcgggggttcaagcaattcttgtgccccagcctctcaagtagctgggactacagatgcgccccaccatgcccagctaatttttttgtattttcagtagagacgggatttcaccatgttggccaggctggtctcgaactactgacctcaggtgatccacccacctcggcatcccaaagtgctgggattacaggcataagcaccatgcccggcctattcttttaaaaaaaattttttttaatctaaatctaacaaaaaggacacctccaaacgctgtcaaacaaaaacagtgtgttttaaaggaagagctagagaatagttaatggtattacactggtgggagaaaaccatccaaaacctttctcataacagtaagaatatgatgtcacttggggatttcacaaagatcaatccactaaattctttctaggtttgaaagaaattaaacggtagggtccctgctctcaggagcttgaggtataatagaaggaattttgcatatttggaaacatgagatggaatttggaagacaaggaaatacaaagcaacattaagtgctaacaagaatgttctgtgatgggaggagatggagtactaacccaggggcatgttaagtagagaacttactggagatgggcttccagagaggttatgaaagatttgaggcacctggattggcaaagaagaagggaacaattctattcagaagagagggtggcctaagccaagcttcctttcatacacagcgtaggcttgggttgcccagtaagatggctaaagttgagaaagaatgctcagatatgaagtgaggaagattctagttaaggtttgtctatgaatagcagtatttactgcacatgtattaagccatgcgtgtgttctgtttttgtgcttgtagtaagtttatcaaacatttgggctaatttccccgtgttttgtagcatagctttggttcttcttcacattttagagaccacccacttgagtctaatgtgccgaattatatctttagcctttccaaacttagaaagccttcccaagattgtcatgccgttcaagtgatggcattgtttttgaataatcactgttgtcctcagaaacaagttaaaaaaaggtttttgtttttcccccacccagtgctttataatcatgactgaggaaaatggcttctccttaactctcatatctaaaaaaacagaatatggtagcttccagcatgcagtgtcaagtagggaccattgtaataacagtggtgatttgggggcatagtggccattatagctcctcctcctggcttacttccaaagaaaaaatagactctgaaggactaattatacagtttgaccagaataaaaaagaaaaacacattagcgagctcttcacatagggtagaaagctaccctttctgttacaattcatcaccacccttctgcagtccaaataaagggaaaccaggtccttgacccgagccatgcaagaggtgtcatgaaggacatacctcccttagcccccacatgaacaaaaggctctgtccactcatcatgacttacaggaagagagagctggagtcaccagggcttagggtgaaatcagcacaactcaagaaagacctctaagtaagcctgcaaaccaaggtccctgccatttatttgaaactactcatcacattttattacatgcattatcaccttattatgaatatttccctatgtgccagcttactgattttgtcttttagtaagatttgcttaatgtaaaaagtcttccctagatgactattcatgctaaacaaacatgaactattatagcaagagctcttctgccaagagcttctcaaactattgagctgtaaacatgaatttatctgtcatgctgacttgataatatgaatttttttttttggaccaccaaaagtattcacagtatcatttcaaaagtagtgtgggcttgtaaagtttttagtggagagctcttggttttgttttttttttttttttttttttaaaacaggatttgtctctgtttccaggctggagaacagtggcatgataccagctcactgcaacccccatttcctgggctaaagctatcctcccacctaagtttcccatgcagctgggattacagggatgtgccaccacacctggctcatttttgtatttttagtagagacagagttttgccatattggctaggctggtctcgaactcctgagttcaaactgtttgcccgcctcagcctcccaaaggctgggattacaggcatgagtcactgcacctggccgagagctcattctttttttttttttttttgagatggagtctcactctgtcgcccaggctggagtgcagtggcacgaatctcggctcactgcaagctctgcctcctgggttcacaccattctcctgcctaagcctctagtagctgggactacaggtgcctgccaccacgtccggctaattttttgtatttttagtagagacggggtttcaccatggtcttgatctcttgacctcgtgatcctcccgcctcggcctcccaaagtgctgggattacaggtgtgagccactgtgcccggccagagctcattctttacttttatttttcagtataaatatttggctccaaaatctaaaagggaagactcttcaaactgttcaagaaagttttcttaaaaatctcagaaatatagttctaacctattgtgttgctagatcttttatttatttatttatttttggagacagagtctcattctgtcacccaggctggagtgcagtggcacaatctcagctcactgcaacctccacctgccgggttcaagcgattcttatgcctcagccttctggagtagctgggattacaggcacccgccaccacacctggctaatttttttttttttttttttttttttttttttgtatttttagtagagacagggtttcaccatgttgaccaggctggtctcaaactcctgacctcaagtgatccacccagcttggcctcccaaagtgctgggattacaggcgtgagccaccgtgcttggcacgttgccagatcttaataacagaaaaggagtgagctctaaagaaatcactggttatataaggatctcagatttaaaagggctatagaaagattaaaatatacagccagtgagaattaagagagttttagcatcactaccctataaaaataagtgtcagaaaggttcgtttcagcagaatgagttgaaacttaaccaaaaaatacttaacaatattaaagtaagaaaataaataagaatagagaactctgtgggtctcgtagcaagaagttgggggttgagggttaggtcattgagaggaccagagttaaagaatgagaaagggaaactgtcccacttccattgtgccttttatgtctatattaaagagaatgaacttctgatgaaaggaaattaaagcccgagatagatcaacatgagaaaagaaagccctagcccattagttacctattgctacgtagcaaataacgcgagaatttagcagcttaaaacaacaagcattagtttcttacagtttttataggtcaggatttgggatgtggtttagctggatggttctggcacagtgtccgtcatgtggttgcagttaagacactgcctgagctaaagtcatctgaaggtttgattggacctggtgggtctgtttccaacgtggctcactcacgtcactgttactaagagacctcagtatcttaccatgtgaactctgtaatgctgcttgagcgtccctacaacatggcatctcgcacccctgcaccaagaggtccaggaaagagattaaggaagttttagtgccttttttggcccagtctcagaagtcatacaccatcacttctatcatgctctgttcactagagcaagtcactacatcccgaccacattcgaaggaagggaatcaagttctccctcttgaaggaaggagtatcagcaaatttgtggatatattttaaactatgacatcttgctacccaagtccaagttcttatgacccagaccaactgcaggctaagagaacttgaaggggaagtagcaccattgcctgtggtctttgtggaaagctgggaaggtagggataggaaaatgaagttctgaatagcaaaaaggagagaagatagcttcacaatctgtaagccaggtatagagtgacattgattgtgggtctcttttcaaataggttatcaagtggaagctttttgaacaattggatgaggaaatggtgctaggtcacaaccagcgtggatttcctaggttttgtcagattatccttaccttctccttgtataggctgtgctcttagactggcacatcatatgctgtggacattgtgcttttcagtgtcagcaagatgtgtcacaagtttcccagaatctcgtagacaagattgaaagagtgattaggccaagagcaggaagtgaattcccctgggagccaaaggaattgggaatgtgtagcccaagtaagacaagaaccagcaggaacatgcctctccttagggtcgtgatacctgttcaaggttttaatgtggaagggaggattaggcttgctctgtgttgaatcaggctcaaaggatggaagttacagggaagctgattctggcttcatgtaaaaaaaggacagtttgggcaggcaaatctatcaaaaaatggagggaaattgatacattcctctatgttcaaacaggaactgacaatctgcccctgggtgggaacacggtagagaagatgacttcaaaagcccttttcatcctaaaattctgatgtttgataattaaatgttatagcatggacactgacatttacattttttacttatgtttttggtttttaaatgactctgcattttgttttaagcttcaaattattatttgaataatgaaattcatcagaacaattagtgttaagaatcatatagcaatttatagaaaaggaagagttcgtaggttataaattctgttagttgctaagaagcatttttaaaattatgtactatagctctttattcagcagacgaaccaattacaatctgtgtaactagaacacttgactaaaattatataatttttacaacgcttcactgcatagatacatgaacataatttatttgtaattggaacaaagccccaaagtagcagttttgttctaccaggtaattaatgctcatttttaaagccttttattattatttctgaagtaatgagtgcacatggaaaaagacacataataggctaaacaataagcccgtaagccaagccaacatattccaggaacaaatccttgccaacctctcaaccaggatttaacttctgcttttcccccattttcaaaaattatagcatgtatttaaaggcagcagaagccttactttcaggtttcccttaccctttcatttctttttgttcaaaataggtagtaattgaagttttaaatatagggtatcatttttctttaagagtcatttatcaattttcttctaacttcaggcctagaaagaagttttgggtaggctttgtcttacagtgttattatttatgagtaaaactaattggttgtcctgcatactttaattatgatgtaatacaggttctgggttgacaaatatcaagacggaggagatctctgaagtgaagatggatgcagaattccgacatgactcaggatatgaagttcatcatcaaaaattggtacgtaaaataatttacctctttccactactgtttgtcttgccaaatgacctattaactctggttcatcctgtgctagaaatcaaattaaggaaaagataaaaatacaatgcttgcctataggattaccatgaaaacatgaagaaaataaataggctaggctgagcgcagtggctcaagcctgtaatcccagcactttgggaggccaaggcgggtggatcacgaggtcagaaattcgagaccagcctggccaatatggtgaaaccccatctctactaaaaatacaaaaaagattagctgggtgtggtggcaaacacctgtagtcccagctgctggggaggctgacgcaggagacttgcttgaacccaggaggtggaggttgcagtgagctgagatcgtgcctaggcgacagagcgagactccatcccaaaaaaaaaaaagaaaagaaagaggctgtatgtatagttctttcagactacaaggcagcaaagttcgtgcatgactcgggacttaaagtggaattaatttcaatatagcagccactttgacttccactgtgttttctgggaaaataggtttacaataggtttatttgaaggatcaaacacatgcatacactgcttggttttacagaacactttatgtggcttaaattcacatccggaactgtcttcctttacccattcatttctcccccagctctttcttttcattccctcccctacctcccatgatttaacttctcttgcaagagtaagatcatggagtgagcaggaccccatgatgttcccgatagtgttattcatcaaaaggtttgtgcaaagaagacagcagcttccttttcagatgaaatcacttttcccccctaatgttagaattggagtaaatcaaaaagccacatctcctttgtggtcagctctagtagttatataaaatcctttaccaaaagcttagaaatggagataaatcaaatcgtggattatgttagggttccatcttatcagtaggtgcagtaagagggttaaattaatgaagacgacaattttatcacattcagtggtggacagaaaaatggtaagaaaatttccatagcaataatacttaaagttatctcaggcacttcttttgttttgttttgtgtgtgtgtgtgtgtgagtgttacttttttccaagcagaaaatgtcttttcaatattcataaagttgataaatcctagtattaatctctaaaagaaacacctccaaattattatttatgccttacttgactccaaataattgtagcaaataaaaaactgacttgggatttggatttgcattcttaactcccatagttctttttttgtagaaagacatttagctttttgaagcatggttttcattggcaagataatctagtatcagttgttataagatcagggtttctcttgatgaggctgttgctgaagaggttaataaaaactggggaaccactaaagagttgaagagttggtggggtagaaagctgacgattaatgtacagatttgcatttgtcggggcctggggcctgtgtcatataagcccatccccacaattacactaacgcctataatgcgacagtgactaatggcagcggcagcaattaggagaatcagctccctctactggactagttaagataatgtattataattagtgcaatgaatattacaaaattacagtattttcttaaaggcacaggcatatgtccagacttgtatttattcctgattacctcacactagtatattagctaattaatgatttgcttttcataaaaatgttgagctagcatatttgtttagtaaagggaataattatgaacaatttctcattttgttataaaccacgagtaaaacacttttagaagttgcttcatttgctatattttatattgcctttccagattgctagtatgttagtttcagcttagaaaaatcagtcatttgactaccttgaggctaaattgaaagaattttttagggaggtacaggcataccttggaaatttcagaacaccacaataaaacaaattttgcaacaaaatgtcacacaaattttttggcttcccagtacatataaaagttatgttggccaggcacggtggctcatgcctgtaatcccagcactttgggaggccaaggcaggtggatcacaaggtcaggaggtcgagagcatcctggccaacatggtgaaatgccatctctactaaaaatacaaaaattagctgcatatggtggcatgtgcctgtagtcccagctactcgggaggctgaggcaagagaatctcttgatcccaggaggcagaggttgcagtgagccgagatcgcactccagcctgggcaacaagagcaagactctgtctcaaaaaaaaaaaaaagtttgtatttacactatactctagtctgttacatgtgcaatagcattatgtctaaaaaaaaaaaaagccatgtatatactttacttttattagtaaaatattttattactaaaaatgctaatgatcatctgagtcttcagcaagtcctaatctttttgctcgtggagaatcttgccttgatgttcactgctgcaggctaatccaggtggtggctgctgaggtttgtggtggctgtggcaatttcctaaaataagacaataatgaagtttgctgcatcgattgactcttcctttcacaaaaagatgtctctgtagcatgtgatgctgtttgatagcattttgctcacagtagaacagctttcaaaattggagtcagtcttcgcaaatctagccactgcttcatcgagtttatgtgatatcctaaatcctttgttgtcatttcaacagtgttcatagcatcttcaccaagagtagattccattgcaagaaaccactttctttgctcatccataagaggtaactcctcatccattcaagtttgatcatgagatggtagcagttcagtcatgtctttaggctccacttctaattctagttctcttgttatttccaccacatctgctgtgacatcctttactgaagtcttgaactcctcaaagtcacccatgagagttggaatcattgtcttccaaactcccgttattgctgatgttttgatctcccatggatcacagatgttcttaatggcatctggaatggtgaatcctttttagaaggtttgcagtttactttgcccagatccattagaggaatcgctatctatggcagtgaatagccctacaaaatatatttgaaatatattttgaaataataagaggctgaaataataagacttgaaagttgatccacaggctgcagaatggatgttgtgttagcaggcatgaaaacaacagtaatctccctgtacctgtccttcagagctcttgggtgactaggtgctttgttagtgagcagtaatattttgaaatgagtcttttctgagcagtaggtctcaacagtgggtttaaaatattcagtaaaccatgctgttaagagatgtgctgtcatcccagttttgttccatttatagagcatgggcacagtagatttagaataattcttaagcgccctaggacttttacaatggtcagtcttggcttcaaaaacaaagtcgccagctgcattagcccctaacaagagagtcagcttgttctttgaagctttgaaggcaggacttctctctagtgatgaaagtcctagatggcattttcttccaaataagtctgtttcatctccactgaaaatctgttatttagtgtagccaccttcatcaggagtcttatctagatcttctggataacttattgcagcttctacatcagcacttgctgcttcaccttgcacttctgtgttatggagatggcttcttcccttaaacctcatgaaatcaacctctcccaacttttttttcttctgcagcttcttcacctctctcatccttcatagaattgaagacagttgtgggccttgttcttgattaggctttggcctaagagaatgttgtggttggtttgatcttccatccagacaactaaaagttttctccgtatcagcaataaggctgttttgctttatcatttgtgtgctcactggagtagcacttttaatctccttcaagagcttttctttgcattcacaacttggctaactggcacaagaatcttggctttcaatatgccttgcccactaagcttaattatttctagcttttgctttaaagtgagagacctgtgactcttcctttcacttgaatacttaagaggccactgtagggttatttactggcccactttcaatattgttgtctctcaagggatagggagcctgggagttgagggggtggagtggccagtttggggggcagacagaacacacacaacatttattgatttagtttgctgtctttatgggcatgtttcatgacactccaaaacaattaaaatagtaacatcaaaggccactgatcacagatcaccaaacagatataataatttttaatgtttgaatatttaaataattaccaaaatgtgacacagacatgaagtgaacctgtgttcactgttggaaaaatggcaccaatagacttgttcgatgcagggttaccagaaacctttttgttttttttttttaaatactatctgtaagcactactgtacaataaagctatgtatgcctgtattttcattaagttgcagagcaaacgtggtaatatttagctttagttttacttcatctggcataagatcaactccttatataacaagatgataaaagttgtggtgtgcttctataatttcattcaagtagataaagttgaaaaataatgacttgcttttataaacagtatgaagcaatgtagtgcagtaaatgaaattttattccttctttacaatgttctcaaaattatttttatgtttaatccaaataaagagcaagaataaagcaacatttcagattttggtttctggagacaatagttagaaagcatgagttatgagtgacttaaaattcttgttgcctgtacttcactttgaaataacattatgctttaaaaagcattacactgctaaaggttaattagaattctgcagaattactatagctaaaagtaggtaacaagatatctttttttctattgtttaactcctttgtttcagaatgcctattcctgtgcattaaaagtgtccctccaaggaaattaggacatctgcagagttgaaaaacacctaagtctcagtcacttagagtcacacatcagggctcagagtgctatgactaggaaaatgctgacctcctttcattagtatgatcgtgcctttccagcttttgatagatccaagcgctatcttcccaccactcaccaaatgttccacctgtcaaagggtttcaggtccctgcagacttcggttttgacctgtggggaaagtagacttcctcgaactggggaagccacatgttgtacatccttctataaactatgattatcattcttagtaggaaaatatgtgatttctttttttttttttttttttaaagtaagcatcaaatatttgaccaaccagttgggcagagaatatactgaaactttttatataacctcatccaaatgtcccctgcatttaagaaatgaaattcttctaattgcgtttataaattgtaaattatattgcatttagaaattaaaattctttttcttaatttgttttcaaggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggtaggtaaacttgactgcatgtttccaagtgggaattaagactatgagagaattaggcttagctttttgctaagaactagctaagtatctcttttaaaaaacgaatcagtgtgcttccatgatgcttgggttacagttgttctttcttgttttggttttcattcattgcaacttaccgtgaatattctgctcaaggtattgagagtgtgtgttgttatctcaacttacaatttgtgttgaagttatcaaaataatacaaatgataatgcatgactttaaaaaagcatgattactcttagacttttttttttcaaacacaagcaacaaaaaccagtacaagaagttaaaaataaaaatagaagtaggaagttgctttttccaaaaaaactaaacatgtttattcttggatttcttttgtcttaaatagtctggcctctcaatacaaccaggtaatagtaaataatgtgacttttcagtgcagactcttacctttaaagtttctcaggaaatcacactataccaaatggcccaccaaaacatacatgattgttatttgagagttctgcaacctattaccctgcacttccacctgaaatatcttagtttcaaggtgctatactaaaacaagaaagagagaaagaaaatttacgaataagttatttttatgcatttgaaatgccatttggatgggggaaaaagtgttaaaatctcacagtatatgcaactttttaggaaactgtcttgcagagagtatagtgtaaacataacttttatatgcacagggaaactgaaaaatttgtgtgacatttaattgcgatattttaagagttatggaatttttagagctgaaagatttattgatgatgaccaatcaaattgatcttctcatcttgtagatgagggaactgaggccgagacagaagggttcaaattatgcaaggtcaagctcagagtccagatttcccctcatattccccattgctttttttttttttttttgagacagtctcgcgctgttgcccaggctggatcttggctcactgcaacctctgcctcctgggttcaagcaattctcttgtctcagcttcctgagtagctgggactatgggcacacgccaccatgcccggctaatttttgtttttagtagagacagggtttcaccatattggtcaggctggtctcgaactcctgacctcaggtgatccacccgccttggcttcccaaagtgctgggattacaggcgtgagccaccgcgtctggcccccattgctttttccatcagagaaaagtccaggtgtttctagggagttgaagattccactatccccaaggaaatgggctctaaaccattcttgattagaagaggacaggcagagtttaaataaatgaaatttgtggtgaagccagaaatttcattttgctcagcaattaaaacctctgcagactacaacagaagctgctgatggaaattggggtggagcctcatttccccattcatactgacgtggatgagcagtgtgaggaaggaaaccaagagaacagcaggcagcagggtggaaaggaacggactgacccatagatcagagtgtgagcacataaaagcaatgaccccactgtcatgtttggccattgcaccttttgtgatagtatctaagcttatgtccctcaaaacagtgtaagataggttttcattagtatcagcttatttcatttctgctcaaattaatttttaaaaaaatttaattccatatttgagcaaataaagatgtcttcatacttgagtaattcaagaccccttttttgctgctgttgttgttttggtttttttcatggttttgttgttttcttttgttgttgttgtttctttgttttttgagatggagtcttgctctttcacccaggctggagtgcagtggcatgatctccgctcactgcaacctccacctcccaggttcaagcgattctcctacctcactctcagcctcctgagtaactgggattacaggggcataccaccacgcctggctaatttttgtatttttagtagagacagggttttgccatgttggccaggctggtcttgaattcctggcctcaagtgatccgccctccccaacctcccaaggtgctgggattacaggcatgagccaccatgcctggccttcaagagcactttttagtttatttaatataattctctttgttgccggtctgtccgttgaagttgccttctttgatgccagaggccaaagacttggcttcctcgggcttccataacaaagtaacacagatgggtggattaagcaacagaaatttaccctctcacatttctggagtgtaagatcaaggtatcagccaggttggttcctccccaggcatctctccttggtttgcagatgcctgtctgctccctgtatcttcacatgaccttcactctgtttttctgctgtgtcctaacctcttcctacaaggacaccagtcatagtggattaggatcaaccctgatgaccttgtttaactttaataacctcttcgaccctatctgcaaatacagtcacaggtggaggtactggcagcttaggacttcaacatatgaattctagggggacacgttttagcccgtaacagaccccagtgatgctgagcataaaagcaaggcctccacctggagctccttcccctggctgtgcgtgagaccaggtcctacctcagacctaaggaaaaagaatccccaaataggaggctgcgaatctgagtgttgaaaatttccccaaatgaatgagatgtgcagtcggatttgagaatccctgacacatcattttaacactccttccttttagttctccgcgcaagcctcagggagtggaaaatggtatctctcacctcccagataaccggttgccttttaagtgctcttccagctgcctgaattaaaacgctctttttttagtcagtttaccaagcagtgtctcattggacttaaaatgtcagaggagaagttgacactttgacccagattctgacattaatttttaagccaggaggtatccttgcaggagcaaaatcgggaaggatggctgttcagctcttctctcctcattttgctgtctactggagagcaactggaagcctttctagatgaggggctccacctcattcgtgtttgttttgtttatttcctctcagctccttcccctcaagacctttgtgactgtccttcctgaaagcagccctctgtgcagccccatagtgtgtctgtacagcaatgttgaaatagaccacattccgcttttctgtcctcaaaaaagatgtagtttagctgggatggtagaacctgaacacagggagttgcaacccagcctaggcatgttcccaggtgagagagcacggtgggctttcagagcaccatttttcttagcattccagcgtctgcacccacagaagtgatgcttctgcaacatcctcttcctaccttaacaggcactctcaccctcaagtacatggaaatacctttatttccggctctggctaaccttcattaatcagtaaccctacttcagtaagaacaaaaatgagtacatcaatatttccagttggactcacctcagtcactcaggacagaataccattgtacttacataccatcgtgcctgaagaagtcatgatgaaagctttggtttccaggagattttttgtttttagagtgaaaaatgcccgcagaagatcacagagataggaaccctaggaaaaaaactcctgagaacaaatgtataaatgaaacaagcctagaacagtcacataccacttcacactggagagaacgttctgagaaatgtggcatggggcggtttgatcgctgtgcaaacatcataaagtacatgtacataaatctagatggtatagcctgctacacacctgggctacacacctacaactattgctcctaggctccacacctgtgcagcatattgctgcactgaatactatagacagttgtaacacactggcagggatttgcgtatctaaacaaactagaaaaggtacagtaaaaaatacggtattatggggccaccatcatatgtttggtctgtcgtggactaaaatgtcattatgtggcccataactgtatttttattggtagagttgttagcatttggaaatgagcacttgctagttgttgtttttttttttttttttttttttcaaataagcaggaaatattgacttactgaatttacttagccataaggccagagagtcactctgtgagccattggccacgctttcccaaggaggtaactgtgccttattggtgcttcaagcagtgaagcaatagccctttattattaccactccccaaatgtgccctccatgtcagaatagccctctggtggctggaaatctcagcactagctgaattaaccaccttgctcctgttttaggacgttcctgcaaagcccactaatcccaggatctgtttagtagcaagcggtacttttctacattcacatacatagacactggatatttaaaaatacgtattgtagctctttctgctactctccccagacatgtcacctttaataaggagaagttgggggcacagcttctctttattataggatgtgaaaaagttttcctctcacagatctgatcacttgaacaccagaagtctccccgcccccacctcctggttatctcattaatgatctaaataagaagagagttccttttatttggcttttatggaggtatggcatatgactttttctaagtaatatgctgtcacactggtgactgtataaaaagatgtccttagaggtcctttcttcccggccagaagctgacccaccaggatacagacgcactgacgttggcattgtagagtagttggagagagtggtcaggttgaatggaaagccacgataaggaaaagtgagggggggtgcagaacctaggagtggcttacagtgagcagcaggaagagaaattggaagatcaaaggaaagcatcaaaaatgatcacaggccaggcgtggtggctcacacctgtaatcccagcatttggggaggccaaggcaggtggatcacttgaggctaggagttcgagtccagcctggccaacatggtgagaccctgtctctaataaaaatacaaaaaattagccaggcgtggtggcatgcgcctgtagtcgcagctactcaggaggctgaggcaggagaatcgcttgaacccaggagatggaggctgcagtgagccaaaatcacgccactgcactccagcctgggtgacagagcaagactgtcttaaaaaaaaaaaaaattatgaagggatagcaaaggagttcctgaacctgcctgaagaattgcttgatgttggccataaacatagtcaactgccttctagttatatataactatagagagatggcatcaaaattaggaaaacaagcatctatacaactaggtagcaggcagttactgggaggttacgagggataagtcactagcttgaaaacttcctattttctttgcttttattttttttttccgcagacttgtggctcctttgatgtgtcacactattgttgtattgttcgccttagttcccttaccctcctttactcgtctggtccatctcaatgacaggattctgtcgtttggcctgactcagtcccttgtataaaaggacatctattaatccacatcctgctggttactgtacataataaaatgtaaacgtggtgtttcctgcctctcctccaagctcacacacccgcatgtaaatactctaggggcaataggaggagacctagaaactaaggtcacccaaatagaatcttgtccctgcaggcggatagctgagctctaaattactctggatacagtgaaggactaaatggttccaatgaatcaagttcagggagaaaagggtcagggggtatggaggttagccaaagagtgtcaaacgttctcctcaaagctattttagaacaaggctggtcaggctatttgggctcagctcttttcagcgtgtgtcataggcagcagccagttgaagccatgccaccatgcagtgcaggggtccaggtctcaggaaggtgcagcgtaccgagagtcacatgaagacctcagatcatttcctgctgctgtgtaatccaggcagtctgggaagagaatgaatattcagtggttgtatgtatgtgtgtcttcatcccagcaagtgacagatgttcctgcccagttggaaaatggaaattctgacttcattgtcttatcattccttccagaacaagcaccatgggctcaaaccctccctggctctgctttaagggaaataatattgtgtctgtgcagaggccctgtctgcacagggtcgtggtagggctggccttcacatggtggcccatgccactgctgtagcttagccatgaggaagagattggtgagcctgctggagaggaaggctacccttacttggtgctcctcctttatccatagacatgagtactcagattttcgcatctagctttcaaggggctggagattaaagatccaatccatactccttggatgcccttttgtcaagataatcccttcttctgtagctcctaagccctctaaggtctgagggccaagctgccccatggcaggaatggcaaaatgtagctgtcctctcagtggcaaaaggtaataggattatcaagtagcaaaacagaagccaagaaaagacaggagagttagaggtctggattgtgcaccagccttggagcctcgcatctctagcagggcactcttaagcgttaggctttggagtttgaagaggagataaacctatcaaattgccaggtgttcccctgcccttgatgcatgcaaatgattgttgacagccagtgtgatggtagatgtgcctcctggaagaaataaaagtataatattccaacaatcaagcagcattgtggcttttttctacaatcagaaacatagcagctttgtgcttgatctcctaagcaagataattttttttaacctgggcattctttgagttctcagtttcgaggtgatggggagcaaaaatgatgcccaagttcaaatggcgtactgctgcagataggctgtctcctggcacacagatttacagagtgaatgaaatctctcattattggtgctaatctttaaccatggtttttaacttacaagttggaggctaattacacagttaccagttaaagccaggtgacctcatttgttgacaacagtgcacagcaaaggaaagaggagaggataaggaaaatatctgtgatttgctcccagaaggacagtgaagctgagcatccatttgagcagagtcctctgagtactggccttggtcagagcttgttggtgggagtgtgctaaggggagatgcctaggtctgtcattggagtaagctgagggtttggatgcaggggaactcaggcagctctgagccacagggtggtagatgggagggattcacagtggcgcacagtctcttccataaatggaaacgtaagaatcggggcacatggccatggcggctcatgcctgtagtcctagtgctactttaggaggccgaggtaggcggatcacctgaggtcagtttgagaccagcatggccaacatggtgaaaccccatctctactaaaaatacaaaaattagccaggcgtagtggcgggtgcctgtaatcccagctactcgggaggctgaggcaggagaatcacttgaacctgggaggcagaggttgcagtgagccgagattgcctgggcaacaagagcaagactccaactcaaaaaaaatgggcacataatggatggaacattctgtcccaagggatgagggagctgtatatctacctattccagctgccttgggattagccactggtagtcattccacctcactcccagactgaaaagagtcaatcacttcatgaagtggggctatccgaagggaccacaggggacctgattatactgacagatttatttttatttatttactttttttgagacagagtctccctctgttgcccaggccggagtgcagtggcacgatcttggctcactgcagcctcagcctcctgggttcaagcagttcttctgcctcagcctctggagtagctgggactacaggcacgtgctactgtgcctggctaaatttttttgtatttttgttaaagatggggtttcactatgttggccaggcgtgtctcaaactcccgacctcgtgatccacccgccttggcctcccaaaagggctgggattttgagccacctcacctggccttttttttcttggagatggagtctcactctgtctcccaggctggagtgcagtggcacaatcttggctcactgcaaactccaccccccaagttcaagccattctcctgcctccgcctgtggagcagctgggattacaggcgtgcaccaccacgcctggctaatttttgtatttttagtagagacaaggtttcaccatgttggccaggctggtctcaaactcctgacctcaagtgacgcacccacctcaggctcccaaagtgctgggattacaggagtgagccactgcacccggccatattgacagatcttttagtctgaattgttatcagccagtgtggtctagtcatgacatatctagctccatctcgagacctcatgtcttactgctgacactacatcctcgctggtactttttcttccttggcttcaggggcattgctgtgtaggctcagatccatgccagatggggtgtgtagggggaaaagctgcataagggaggaatgtcacttggcaacactcaacaagggggaatgggcctgcagtattctcccagagatgaatgagcagcccattctaggaaatatccctttgaaggaatatcttctctatggtacatccaaacttttctctggaaaacatgcctcttcattctgatgactttctatttattctcttcatcttaccatggttttacaaaagaggaattttaacatactcattcagcagagttaaggacctcctctcttctgcgaacggggagaggtataacaaatatagtaaaacaagaacagccactgcccacgttgtaggggtaagtaccctgcccaacctgcagacagtaaatgccacacacagctctaacagtgacagggggagaaaaacgtcttcagttactggcctgaccttagaggtaaagcaacatattaacagagagggtctgattttaaactttgagctgaacatacttctatagtatcttaattctcagtttttaaaaaattacatcatctagaatggcgtcgtccttgctcttccttttttcttgtgccaaataatagccccctttggtatatgttattgttttaattgattctcaaacctctccttaacattttaacaaacataaaatttgatagaaatgggctagactaaattcagcagtccaggaaatcgagtatttttctacacagatttgagtgtcacccaagatacagtatactttgctgaatctccctccatgatactcttgtggttttatctattttaccaaaacacttccacgtaaaacaggcttccgttgactctgtttgtcctttatggacccaacaggggaggaaaaaataccattgcactgggtttatccacttactgtggagttggggaaccagaaacaaccactggacacgttgcaagcgcgtcaaggtttccaccgccacctggtggctagatggagcacagcatctgtgtaactggtgggcaaaggcgttctgctccaagatgtcaaagtgggggagaaaattatgggtgttctgcaatcttggcaaaagaagagtactgtactccttatctttttactgcttctccatgttcacccttaaaagattgatttttattttttactcagctctcctcttgtttttcaggttgacgccgctgtcaccccagaggagcgccacctgtccaagatgcagcagaacggctacgaaaatccaacctacaagttctttgagcagatgcagaactagacccccgccacagcagcctctgaagttggacagcaaaaccattgcttcactacccatcggtgtccatttatagaataatgtgggaagaaacaaacccgttttatgatttactcattatcgccttttgacagctgtgctgtaacacaagtagatgcctgaacttgaattaatccacacatcagtaatgtattctatctctctttacattttggtctctatactacattattaatgggttttgtgtactgtaaagaatttagctgtatcaaactagtgcatgaatagattctctcctgattatttatcacatagccccttagccagttgtatattattcttgtggtttgtgacccaattaagtcctactttacatatgctttaagaatcgatgggggatgcttcatgtgaacgtgggagttcagctgcttctcttgcctaagtattcctttcctgatcactatgcattttaaagttaaacatttttaagtatttcagatgctttagagagattttttttccatgactgcattttactgtacagattgctgcttctgctatatttgtgatataggaattaagaggatacacacgtttgtttcttcgtgcctgttttatgtgcacacattaggcattgagacttcaagcttttctttttttgtccacgtatctttgggtctttgataaagaaaagaatccctgttcattgtaagcacttttacggggcgggtggggaggggtgctctgctggtcttcaattaccaagaattctccaaaacaattttctgcaggatgattgtacagaatcattgcttatgacatgatcgctttctacactgtattacataaataaattaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggagcaccattgtgctggtgtgaatgattccatagtaacaatcttgaccatttactgacgtacagaccagtgagaagtcttcgcatgttgggtacccacacctgttgtgtcttaattgcaagtctgagtaggaagttggggccaacatgtgtctcccagtgctgggaaaatatttcatagacctaatttacagtctttacttgatctaaaacattttgctgccatattttggccctcaagtttgtcccaaatgagagacaaagggaaaagttccagggaaataaaaattaagacagctgattatctgtaaagcatggtttctcatcctgaacgctactaacattttgcagggaataattccttgttgaagggagttgtcctgaccagtgtaggatatttatttattttatttatgttttttgagagtctcgctctgtcacccaggctggagtgcagtggcacaatctcggctcactgcactccagcctgggagacagacgagactccgtctcaataaataaataaataaataaataaataaataaaaggagggcctggcacgaatgacatgcagggaaggcagtgagcaggtggaggtccctgtactcgttgtggtgccttatctaccaggcggttgagttgacgtctttgtggacagaattcgattacaaaggtgtccgaaagtctccaggtgggggagagttttgtagcgggcataatttgggttgtaaattgactgttgtctcctgagcagtctcctggtgagggagagtttcactggagctttgaaacacatgttagacagccttgccctgtagggagtgtctcgtgaaggagaggtaaacaattataattgcatttctaaagggctaagtaggacatgggaaactggaaaatggagaaaagaagagaaaaaaatagtaactcattctctttttcttagaaaaatgaggatacttggtcacatcctcacatggtgaagaataagatggtctcttcatttcccttcaacactagtcccatcgtgaggctctgccctcatgacctaatctaatcctaactgcctcccaaaggtcccacctccacatcccattattggggattagggtttcaacatagggatttgggggaaacacaaacactcagttcatagtgatatctgactgcgattccaaaggtctgaggacacattggccctgttgtttttgctgtgttgtccttggcctcaggtgaacattttagctttagattgcaacattttaagctaaaaacactaagctagaaaattaaacttatctcgtcacattctgcatggtgaacaaactcaaaactcacctgagtgtatcttgttttcatgagaaaaaatgaccggtcatctcccttgccctgttagggacagttagacatgactgctgtatgaagatatgtacatgttaacaattcatatgtacaagctactgttccattttgcctggcccaaggggaggtagctagctagttggggtagcagggcgaattaaccctaatataatagtacatttctaatgccaccaatgaaatgaaaaccagctctcaaacatggcactatatgggatggcattccaaggccaactcagttacagtaactacagctttaactttgatcattttgttaccagaaaggggtcccaatccagaccccaagacagggttcttggatctcatgcaagaaagaattcaaggcgggtccatagaggaaaaggaaatgaagttttaaagaaagtaggaaaataaagagtggttgctccataggcagagtgaacctaagggctgctggttgcccattttattgttatttcttaattatttactaaacaagggctgaattattcatgcctccccttggtagaccatatagggtaacttcctgatgttgccatggcatttgtaaaccgtcatggctctagtgggagtgtagcagtgaggacaaccagaggtcactctcattgctatcttggttttggtgggttttgaccggcttctttactgcaacttgttttatgagcaaggtctttatgacctgtatcttatgcagacctacaatctcatcctgtgacttagaatgacttaaccctctgggaatgcagcccagtaggtcccagccttattttacccagcccctattcaaaatggagttgctctggttcagacgcctctgacaattttaaagctaatgaaaaaaatgtctagccaaatgtatatatacatacatatataattatgaaaagataatgccttataatcttgattcttaaattgaggtatattgatagtattctcccaatggtctggggattaatcaataggtaatttatacaaaactgaagtgctgccaaatagaattataggagtagctgctgcgcaaaaaagattaatgagatttggggagactttgctgtggctaatatgatgggtcaggaagagtacaatctcagtacaattttaagttgtatttatcttatgaataattgggctattctttcatatgcccaagggccattttatagctctatatt

SEQ ID NO: 2 - DNA, 226000 bp, Mus musculus
agagggagagaggagagaggagagaggagagaggagagaggagagagggagagagggaaaagagcaggaatggaataaaagaaaaacaaacttttaggaaattttaaatagaaaacaggaaagctctttctggcacaatgccaagttgaccgtttcctctgagcacgccctgctcaggaatgtgaatgggatgaacttcagccgtgtgaagtgagactgctcatgctaaggatttctgtttctgtgggttatcatttatcactgggttttttaaataggcctactcaaaagaagacacttaccctcctctttttaaaaataattcctgcctctttcccctggcacatattgggtgggggggggggggctcactctgctctatgttcagaaacgctcaatataatgccccactgtcacgatctataaacgtttaatcttggacaaaaggtctcgagctttcatttcccgtaagatctttcgagatctggaactggatctgttctcctgggtgttcaggttccttccttgttcctacagacaggagatcatgatgataggtaagtgtattggggaaggagtgtgatattcaaggtatgaaataaccagtccccctatggttaagctgtagttaagctctaagactgttttcctggcctgtgaatgggggttgggggtagtagtaatgacttccttggatttgtgtgtatgtgtgtgtgttctgttatgtgtgtgtctgtaagtatacgtgtgcctatgtatatgtctgtgtatatatgtgtatgtctgtaagagtatgtgtgtctgtgtgtgcatgtgtatgtatctgtaagtatatgtgtgtctgaagtgtgcatatgtgtgtgtgtgttataggtgtatgtgtgtgtatgtctgtgtatgtgtgtgtgtttaagtgtacgtgtgtctgaagtacagatatgtgtatctgtgtatatgtgtgtgtgtgtaagagtaagtgtgtctgtgtgtatgtctgtctgtgtgtatgtctgtttgtatgtatgtcggtaaatatatgtatatatgtgtatgtatgtaagagtaagtgtgtctgtgtgtatgtctgtctgtgtgtatgtctgtttgtatgtatgtcagtaaatatatgtatatatgtgtatgtatgtatgtatgtatatgtctgtgtgtgtaaatgtagtgtgtttgaagtatagatatgtgtgtgtatgtgtaagagtatgcttgtctgtatgtctgtatgtatatatgtgtgtatgtctgtgtgtgtatgtgtatatgtgtatgtgtgcatgtatgtacatgcctatgtgtgtgtgtgcgcgcgcatgtgcatgcttgttgtaagtcatccttaggtgatgctctggatgctgaagctttccacttttttttttttttttttggagataggatctctttcctggcttaccttacccaagagtctgtctgtctctctctccctcctaagcaggtgctagcatggctgacatttttatgtggcttccaggggtggaactcaggtcctcgtgtttagatagtaagtactttattgactgagctacctccctatcctttccttggcttctgtaggaaatgaatgccatatgtaatcaaagcaaacgttacttagcaaatatttgttgttatttgttgaggaccttcagaggacagacattcaggacaaatacaaaaaggtatctgtagagttgggcaggtggtatgtaggcatgttgatagatgagtgctgacttctcagaaaggaagaggtggagacctatcctcccaccacacttacaggggattggattccttgctgtgggaaagaaagagcgggccttctaggttgctttctattgcagagttataaaaaaatcacgatcctaagcaactcgaggacagggcttattagcctcacgcgttctgatcacagtctaacgcgaagggaactcagagcaggaacacagggcaggaacctgaagcaggaactgggcagtggcagaaactgcttgttgtttttttccctcctggcttcttcagcctgcttccttacacaagccaggaccacctgctcagggctggtctcccacatcaactaataagaaagaatatgccccacaggtttgcctgcatgtcagtctaatggaggcatgtctctcaatttaggttcccccttcccagatgaccagagctcatgtcaagttattaaaaaattaagcagcaaacacatcaggtaaaggaaaaggctgtggcctcagaagccaggaatgcatttggtattaccttcatctccttccactagcctagggagagccaaaagcttggcgtctgaagccacattaggtcgggagggtggtggtagtgggagcatgtctggatgggtctaatgtaattttaacactgggaagtttgtgtttaatctaggagaaaatggttttacggaggttcatttcactggataagggcagatccaaaaaaaaaaaaaaaaaaaaaaatcgagagcagagttccaggaagaagtcctgggtgatggaggtggaggaaaaagagccatcactcggtatcttttctggcctaactttgatctcttccccatcttagatttttacctccctgcctccttcaatcccagatgccggtccccttctctgaaattatccacgtcaagcaaatatgcaatgataatacatttaaaaacccacttcccatctccaaacacggagaaaaatgggtcattctgcatcctgtgcccttctctggtacattctaaagacaaaaattccagattgcagtggcgtgaagggtgacctcctaccaaaagaaaaagaaaatagaaaaaaaaaaaatcctgtttcttttgctaatgttctcggcctcgctccacctctccaaatagagagaacgaactgcggataaaaatgcacgcatcgcagccttagctcctcaaccacatttgggagaggcctgcggggtcgggtgactcaagctcgcgcggggacgagccgagagcgctcccgacttccctggaaccttaacgtcctacggttcaccttctcccgattgcggggtcctctccctgacccagatcactccccaacttggttcccagaccccatcgggagcgcggctccccttagcccaagacgccgcacctgtgggctctgggtcgcctcccgctgcgctcgggcgcagctccccgaggctccgctaggggtctctgtcgggtggcgagccgggtgggcgggatcagctgactctgccggctgcgagccccgccgcctcgctccagctctgtcagtttcctcggcggcgggaggcgagagcaccgggagcagagcgagcgcggggccaccggagacggcggcggcggcgcggacacagccagggcgcggcggatcttccactcgcacacggagcactcggtggcccacgcaggatcacgatgctgcccagcttggcactgctcctgctggccgcctggacggttcgggctctggaggtgggtgccgcgccttgggaacgagactggggaggcgggcgccgggaggacgcgatcctccccaccgaggagcttgaatctcgagacgtggggggctgtcacgggtagaccgctcctcgccgcccccgcctgcgggcgccctgcgcttcggcggctctggcccaaccctgcccggggacgcgctgcccgagcgatgaagagggaatgggttagggcgctggggtccccatatccgtgccagcctagggctggaaggcgaggggacgagcctgaacgcagaccctgactcctccctgcgttgagagctggactccgggatgcgagagacacccagttcgagggggaagggacacgtgtggaaaaccgaaagcgtagcgtctcaggattcagtgccctgcgaggaaatcgccgcccttccccttccttggggtcctgggttggaatgggggcagctctggatgctggggagcgcctggctcacactcccttcccacccccgcctgtcttgactgcgaagctgggctttgctcctggcggccgcgggcggcggctgcctgcgcagcgaccctctcccgagtcggtgcggggtcgcgcaccgccgccttccttttgcaaactttgtgcattttcgtgtctcccttttgtgtaagttccaagtgatgggagggatcggaaagtgcggccacccggcaccgtccctcaacctggacgtccaggactcttcagtgcacctccagtttctccctgagtctgagaaggtccccgggaacaaaagccgcgacaccccgccctcgccgtccagggcgcggtggcggagccctggtagttggtgcgccaccgccgttcctttccccgagctgcgcgtctgcccccgagggcctagaggtgctgctagggccccgcggtctcccacccccgcatcaccaccacctactggcaatcctgtgagggactgcaaagtcctgagagagagagagagagagagagagagagagagagagagagagagagagagagagagagagagagcgagccgggagtgaggcgtgcgtctgggaagggcagtgcctggtggtggggaggctgaggctccagggcatcaaaggaggcgtttgtctgattaaggtgcggcctcctatggggcagatttgggaactctagcttagtcaccctgggggggacacaggatgctggggagggtcctcagggttccttttttttttaaaaaaaaaaaaaaaggggtgcagataaaaggattgaatagggtgaagattaagacggagaagatggcgcctctgcagtgcagcaaagaaaagctgtgtggaggctgcagcctgtgaaatccacccaccactaggtgtataacaagtcttccccattcatccaactctccagcatgcagcacaaggcttgttttcctttttatccagagatgcctggaagttgtttgcgtggcagctggttttatttctcttcatttgtaccctcttcaccatctaagcatttgctaatagcccttcctcgtcgtcctcctctttcccctctacctcataggaattttcccaaaaagcaatttccgggcgagtgttttcctgcaattttgtggggattggctaggctatcacactagtatgagtttttatttatttaattttttttagctcttaatttacaaggtcattgaacttttagcccctctgaattttttttttttttttaacccacaagtggcttcagaatctgtaagtcacctcagactggttaaaacaggtcttcgaagagtcttaagaatttagtgttccatttttttttttcaaagccatttaatcaagggaattctgatttctctgacgacctaagaatttaattgtatagtcattcggtttttctaattgttttgctgtgcagaaacacgactaagtaattaaaggaataactttaatttttggagcattttacttttcttgagcattttttttaacttgtataaaaagagtcacagtgtaggccaagatgaactggatttatgttttggcttgtgcgattgcatatcctttttctgccgaacatttggagatgctcctgcagttatcatcacctttaaagggttactgggagcactacattcgtgcctttggtgagtcactggaaggataggtaattcatcctgatgaggtttgacacactttgcagttctgcgtccactgaagccacagaattatgagttggctgcgttttgtaaatcacagaaaatccgtctgctgcaggtggctctgcaaaaagaacccgtgtgatggagggtgctgatgatggggccatgagggtactgatgctggggtctcgagggtgctgatgctggggcctccagggtactgatgctggggcctcgtcttccagggcgtcggcatttcctggtttggttttattttcctggtatgttgaacagaggcatgcgtttagcaaaccgtgatggactcatcttgtttgcttgtatagagctgataactatcaacttgcctcggtagtggtggctccttcactgtctgcgactgctgcccggtagtgcctctctgatggtagaagcctactcatagaacagcgaagctgacattctttttttgacagggatccatcgggagtcaccggttactgcttgtcagtgggaagccatgatactggcagactataaatgcttctttcttatcacccccaagggatagcgtccctcattacacttgtaaggctgcaagcaattaaaagatggaaccgaggaaatgaaaaggtatatacaggatcacaaaactaaactggaaaattcaagatttaagattaaataggagaaaaataggatcaatgggctactggtttgaaggaaggtgaagttacttttacggctaaggtttttaagtttttagtttactgtttatgacacgccaattttctatatctctgtgttaaagattatctgtcagtcatcctgcatatagacgtgaagaaggtgcttaataaaatattatgcgttatttttgcagaggtgttgtcgtgggatttacagggcatctttgactaatacatttcttttctaatctctgccttttatgtcaagatggacctgcacaaacatactttaaatatcaagctcatgtttacttgactgtatatattttattgccttctcccacactgggtacagaagtatgcagggtgaataaagcatgcacataattataaaataggagtgttgcgtaccaaaaaagaaagtacagattaggcaaagaaaaaaaagaaaggacacagaaagtggggtactcagaaagtgtagcaggataaagacctagaattaaaaagagtaaaggaacaagagaacacgataatcctgggatgtttcctgggtgaaagtctccagccaggtttgtgtcctgggtctgtgaatggaggttaagtatttgcatggattgtatttgctcacgcacagacactagagcctacatgcaaggcctttgtcttatctgtcttccctgctctcgatttccagccaggcacagataaggttttacataatgaaggcgagaacaagtgtggagttccatttgattcatggcctcgtctgttcatttgggacaatttgattgattgatttttaggccaaatcgtgtctctcagctctgatcacctttatgtaaacccccataagtggaagcttatggagcgtccactcatccaggcaagacaggaaataaacagaaactgtggcaggtgtaggccagactctggagctgggtgaagaactggaagaaggagaccaaggctgaaagcagcctgggaagtatccctagcaccatcttgaccaggggaggtaaggacaaaaagcttcacccaccatgcaaacttccaggagggaagggagaagcaaattttcaaagtgcttccataaggaacgttagccaagagttgtcatcctcctttacacatcagggtcacagagtgtctctgccttcctccctccctccctccctccctcccttccttcccccctctctcccttccttcctgtgtttgtgtatgtgatgttgggatttcatatggagacttaggcatgatggacaaatgcctgctgcactacatccccatcccaaggaatcatgaagatgaaaacaaaaccagaagcagaaaagttccagagtgttgtcagagttccacccagtacatcagaaagagaatcccggaagcaaggcctggacattggcattaagggaagaaaaaaacaaaaaattctccgggcaattttaaaatagaaactgtgatttttgagggcagttacagatggaccaatttgaaccacattcaggattcatcaagctgttctgaaaccaaacgagccaagtaatggcatggaagctagtagctgtgcaggaaaacagggaggagggcagaggaaagctcgggtctgtttgcagcctcgtcatctctccttaaggctgctgtggcttgacattacctctctgtagccaggactgcagtcacattccaccccctgggctagatgaccttgtggccttttgggaaacttgcctcacagagcacacacctgcgtttgtgaaggcctggcaggcagccagcacgctcagctcccaagccctaacctggttattattttttttttctttctgttcttgtttgtttcttgatgcaactgtgacatcttttccttctcatagtgggatcctagatacaaaccgtggagtgcagagtgataatcaatactgtctgatgcaagagctcctgagtgctgtaacctcctgcatcttaccttccgtgacctaccctcatgagtgcgtgggaaagaggacaggctaaggtgggggagtgagcatgctccctggatgagtagcaaggataagcaactatacatattatatttcagtcacagtttgcccatggaggtattattccaggagagatgttacatagctctttccttaacatggattgcttttgagagagacgaatatttattatgaaaaaaaatgttgggtgaattttcttttcttcagattgttctacctaggaggtttgactggtaccatctttgggacaggaaatgctcccaagaatgctggattagaatgactgctgtagtaatttatttaaaatgaggttttgtttgtttgtttgtttgttttttgtttttttttgctactagttttaaagaaagcattcatcaagaaatagctataaaagagattacggggaacttgggttcacatacattcagtcctagcttcagtactgggtaaagaagatattttatttacatttatttatatggaaactgtttttattttttgagatggggatctgttttgattactttttgttaacttgacagagactaaagtcacctgggaagagggaccctcaagtgagaattgcctttatcagattggcctgcaggggtggggcattctcttgatttatgattattgtgggttggcctagacaactatgggcggggccacccctgagcaggtagtccttggatgtataagaaagcaggctgagccaaccctggagacagccagccagcaaacaccccttctgttttagttcctgcctctggtccctatttgagctcatatccttggctgtccttgatggactgtaacgtgtaagatgtaataaaccctttcctcccaggttactcttggccataccttaaatattgtattatcattttaaaattatgtctatatgtgtggctatgtgcacatgagtacagttacctgtggagaatacaggccttggatctcccggaagttagaatttacaggtgtctgtgaatcaactgaattggaagaaccaaagtgctcttagtcccctcagcccctaagaagacagaactggagtgaacatttgtaatactgattttgatgtcaggtgtattgttaggtcagtaatttgaaccattgagtgtttctcagatgtctagaaaaggccagcatttcacattgctttctgttgctgtgacacaatacctgagacagccaacttaaaaagaagaaaggtttatcttggtttatagtttgggaggtttaagtctatgattggttggccccataattatgggcctgttgtgaggcagcatattatggccagctgttcctgtcatggtggtctgcctggaagcaaacaggagaaaagaagagaccaacttgtcagattcccacacaatccccacctttaacgacaggggccttcagaaggctaagcctttgacccactggcctttgggtcatacttatgatttaagctataacaaacatggatccagaaaccaaatgggggcaaggttgcttgagcatgtgctcaggataatgtgtaccctgagatactggccatgggtaaatttctgtgcttctgtaaaatgtagctagtagtatttaatgttgtcaaggattaatttaatatataaggtccttacaagtagataaatcgatatgtattaatatgtacttgatgtatgatcgtaactaggtgtcgctacttttataggagggtagaaaattaatatgtttttctcacgcatagttacagaaatctaaataatcttcatgatatttcacttattagaataattgactcacttagtgtctaattatgagtaagaagaacttggcagtttgttttctgtaaggttgaatgaatttacccaagcatggcttagacctgtaatcccagcactataggagacatgagtggaggatcacaggttcaaggtcagattgggctatgtgaaaaaaaaaaaagatttaaatacagcacaggtaaaaggggtttggtttctggttttgtttgttttttgtttgtaaaatatcatttatgtgattttctatttcagttggatttttagaaattttagaatgattcgtgttcactgaaaaaaattaaacagtagagaagtgtgcagggtttgtacaaatagagaatgttcattttttaatgctgtgcataccagcagttttccatgtgtttaatattaaaccagtttatgcgctggcttgattattaacacaattatttattagttagacatcttcgggtttgtgtgaggacctggggacaggcttagttttgtcttcagctaaaccttttcaataaaaatgaataatcaggctttgtcatcagaacagatatagaagaatcaaatgccagccaaagaatgttggtcctagtgtagacggctgcaacagcttcactcaagacagggcatgaaggcagccttcctgtaaggaaatcagactcaaaataaaatgagtttatataactgttgtgctaggctctcaggtcttttacctacatatcagttaaaaatacacgcagaaaacaccagcagggttgctcatgtgccattttctctctgtgtgtcaaaattagtctaatgatatctgaaacttttagtaatgatattttaatgatatttaaaacttaggactctgtgattaaattctggttgcaaacagcacggaaggatcaagaagcaaaggccttagggttccaagtgggtttttgttaaccagccgtgtatttatttagtatttggatggaggtcggttttggtctggctgggagtacagaatccatttttaggactcaccctactcagggatgttacacggaggaaggccagatggtctcagggccccgagtgcagggccagtgaacccacatgagaaatgaggaaagggaacacattagagatgcttttgtagaccgtgggtcctgaacctagtacagcaatgggcacggaacaggacaggagtcccctcattttcagatggcctgggttttttttcctctccagttcaaaagatatttcaggttaaaaatttcgctcagaaacaataaaaaatttactttgtttttggtgatttcccagttatgaagctgttctttgtctgatgtttttccccctcagggaatcaaatttgtactatgtcctcggtttctagagagccacatactgtctttatcttcaccgaaaacagtggggctttctaaatgatagtgacaaattactcttcccgcctctctggacacttaggagagtaagagatccgtcatggaaagtcatttgtgttaagtgaagaaatgctttatcgttcctgtcgccttgctaaatttcaaagctttaatgacactcatatatcttcgccccacagagacatttttgcaggacaataaacatgaggtttaatcttaccctggaggtatgtttgtgtgttttaagatgtgccctttcaggcctggttaccaaaaatctcatttgttcagctttgctttgtctgcacaatcttctgtttgacattaattaaatttaaaattaatgttttataaatacattccttagttatttaaaaattatagctggataagtttcaatgtgtatatttactgtgcacaggcctctgctgcatgaggacattttcatgcaagtatatgctgtatgctgaggatactctcccctgccctgccctgccctgccctgccctgccctgccctgccctcccctcccctcccctcccttcccttcccttcctcttctctccccttcccttcctcttctctccccttccctctccttccttctttccccttctctccccttcccttctttccccttctctcccctcccctcccttcccttccttcttcttctctccccttcccttcccttcccttcccttccctcccctccccttcccttcccttccctcccctcccctcccctccccttcccttcccttcccttccctcccctcccctcccctcccctcccctcccctcccctcccctcccctcccttcccctcccttcccttcccttcccttccctcccttctcttcccagtttcttccagttagcttccttatttcccctagagcgtttcacttctactttcatatcccacatacttactttttatgtatctacataagatctgggaaccacaaatgagaatgcatacaaaaaaagaaaaaaatccatctttctgaaattggcctgattagtgtacggtgattattttcagtttcttcttcgtttattatttcaagcaatataatttcattctttacgatgggaaatactccactgtgcatacacactacattttctttacccactcctctgttggaccctagattggtttcataacttgtattattatgggcatttcaacattgcttagttattatgaacatatctaaacatcgatatgtctgcatatacttaattggtattttacagtaaaatgaatgaagcaatatacatttatttttgtggttgttttctgtgctttggattaaactcaggccatgtgcatcctaggtaggtactgtaccactgagccacacacatctctggcattaatctttttaaaggatcgatcgttggagttagaatacagtccattgagtctcatctggtgtggtcatagctgtgtgcctcatttgttcctctactcaggggaacaaaaccccactgcatttcatttttaaaagaaaatagaatgttattatctctcaagactttgtggttaatcctagtatgttccagttattgaatgaagtttcaaaagcataattactttttttttttacaaatgtatcaataacttaagttgtagagtatgatttatacacaaaagttaccatggtaaataagcaccatttctcagcccaatggagtttttaaagcatttgaaaatgtccatcttttttttttttaaagtgatacaacgtttttgaaatctcagcttagcattttggagagtgatactacaatttaccatatgaaacatcacattttatagcaaatattccccattctgatagttaatcgcttgtcatagcatgcttgtaacaagtataattttaccgccacaatatattaatttgagatgaaaagttcttcagacactccaatagaaatgaaaagttcaaatacgaagattaattttaagaatatttaattcttagatacttgtctgttaagtaaaccacatttaatattaaaatctaatttcttcagagaagttactggctaatttttcttacctggtgcattagttacatttttgttgctgtgacaaaatactggacgaaggcaacttaagaaaggaagaccccccccccaattcccacccctccacttcccacccccaccccctagtgctgggtattgaacccagggtcagggtcatgcatattagacatgaaggcaaatgctcttcaaactgagtgtcaaactcagttttatatcggctcacaggttgagggtacaaacaaagcctcatgactcataaagtcagggtcctggggacacaagactgctgatctgcttgcacccatagtcaggaaagcaggagatgaaggccggtgctcatctggccttttttttttcctgtcaccgtggcatggcaaccattcactgctaccacccacttgagaatgggtcttccttcctctttacactccctggaagcacacacatagacacacccagagttatacttcccgatcactctagatcctgtcaagtagacgtggagattaaccgtcacttgcagagaagcctggattcagactgggatatttagacaaggagaatcagctttttccttgttccccaggaagcagcaggtggtcagttgaataaacgtgggggtaagagctaaaggagaattctacatggaagtgtgctgtgtgctaatattttaggtaatatatatatatattaccaatatactcttgtatatattaccatgcatatatatacatacatatgtgtgtgtgtgtgtgtgtgtgtgtgtcaggtagtgtgcatcactaccctgaggtaaactgaggtatctgaactattcacagtaacatgaaagaacaactgtgaactggggtctgctttgaggcagttaaatattacaaatgaaagtggaactaggagaatactaggaatattaatctttgtgtcactagggacaataccttgaatccagatttatccagtacttgataaatacttttggtgagcactgtagaaattctacagtgcattgatcaagggttgcatggtttggtgcatggtagacggtttagcagggagagtgatttctgttcaagctggatctgagtgtccatgcccagaacccatgtgaaagcatggcacataactgtgacccccatgctggaagggtaggagaattctggagatgtactggccagcagaaatgggagctacggggtcagcgagtgaccctgcctcaaaaataatgaggacatgatagaagaacatcactgccacctgacattgatctctgatctctacacaagcatacagggtttgttctctctctctctctctctctctctctctctctctctctctctctctctctctctctctctccacacacacacacacacacacacacacatacttagagacagagagagacagagagacagagagagagaagaaagaagaaaaaagaggaggaggggggaggaggaggaggaggaggaggaggagaagaggaagaggaagaagaagaagaagaggaggagaagaagaagaagaagaagaataagaagaagaggaggaggaggaggaggagaagaagaagaagaagaagaagaagaagaagaagaagaagaagaagaagacgaagaagaagaagaagaagaagaagaagaagaagaagaagaagaagaagaagaagaagaagaagaagaagaagaagaagaagaagaagaagaagagaaggaggaggaggaggaagaggaagaagaggaagaagaggaagaaggaagaagaagaggaggaagaggaggaggaggaggaggagaagaaggagaaggagaaggagaaggagaaggagaagaagaagaagaagaagaagaagaagaagaagaagaagaagaagaagaagaagaagaagaagaagaagaagaagaagaagaagaaaagaagaagaagaaagaaaactgtactttccaacagctgaaagccagcactactttatgccattccaaagccagcactactttatgccattctattgacaggcattaaaaatcttgctgaggtcattatctttctcctgtttgctcaggcttgatttttaatgttttatgtcaagtgttaaatcattctacaccaaagggttcaggaaatttaagtttgctagaagtaagctgaattttaagataatgtagttgtgttgggtggggaagtttctggaacaaccaataaaaactttttttctctcttttttttttgagattgttttactatgtagttctgactgttctggataggactcctatctatctatctatctatctatctatctatctatctatctatctatctatctatccatacatacatacatacatatataccagtctggtttcaaaggcacagagatcagcctgcctttgcctcctgagtgctgggattaaaggcatgttccactacaacccagcctaataaaatctcttgatgtgaaagtagcttacatcttgctgttagtagacgaactgcaaagggccctacttacaggactatattggtaatactatagtgttatttagtgaaagatgagaggcaggaatccctgagggaagccaaagcaatttcagtatggcttaaatagttgaagggaagcttgcaggatggacagagatgtgcctaccactgagtagtttattaacatggctgtcagaaacgtccaggaccaagataatgaaggatgagggttcctagagggtatatgaagtttatttatttactttgcagatgctcctctgtttttagtatatttttaccagttgttggggaatttcatacctgactacaatgtttttagtttttgttttttttaatcatattcaccatgtcttcctctcctaacttctcccagatctacacccccttctttcccacccctcccaactttatgtcctctttatagcaataaaaacaccaagtacactttgggccagccctatactcatggatgtggggccatcccctggaatgtcatctgcctgctaggggccactcccttaaagaaaacaaactctccctcctccagaagccatctactgtcaataactcttcagccaggaatggggatcaccgcccctccccctccagtactggaatgtcgactggcttgatcatgtgcacttcttttacaagcattcatgcctgctatgtgttaaggttgcaccaggcctgccatgtttagagggcaccatttaactttggtccttcaaaacccctggctattaaaacccttttgatccccttctgtagttggtcccaagccttggcatgagtgaagatgatagggatattctatttgtggcagaacactattctgggattttaatatagactgggggatcagattcctctgttcctttgtatttgtgttgcattgttgagcttttatgaactgggctcagaggttctttcgtgaacttctgagggtcatgttggaaggacacagatgacaagagttcagtgggttgacagtatttctcctatgtgtgtgtgtttttagttgtatttattgacttcataaataactgataagatgaggaaaatgtcattaccaacctccttcctggagaagaacagacattcgataaaatatccaagggtttattgtcacatattaaaatgtttgcaattttgaagtaatggcgtgttgactcattgctcattggctcattcatatcagagtttgaatatatacaatccagtcccaagtccctgattctgttgtcagccatggagctggggtaaatgctgaaattttaacgggattttagggtttggggtgtcacatggttctatacctacttcacaatctcttagggaatttgagcatttcattgatgctgatagtgatcggaagttatgatgtttttataactaatttactgcacattgcttttccttctttgatcacatttttaaaaagttaattcctgagcatgtacaagatggcttatgtttcaacaggagcccattctgtcatctctgtgatgctgtatatggagaggtagttcctgctgtaccttgtcaatttcacagtctaatgtagaaggaaaatgcaggaaaataattacgcatactatgtcaaaggctacaataaaagcctatgtaaactcttcacagatatggctgagagcctttgggcaggacttcaagggtaaatggaagttggtcagagcagagtggggttcctagagatgaagaacacacagccagggggtaaagggttaaaagtagaagccttagcatctgtgggatgggatgcgggtgtgtgtggaggggtaactgggaagggggatattatttgaaatgtagacaaataaaataattaataaaaaaagtagaagctgttgttatgtggatatgagactcagggtttcagaagcccttgatgaatctgaacttcattttctgaacaacagtgcacttttacatgttctagaaacagcagtggtcactgataactataattcatctagatttaggagctttaatgaaagatcttgttaatgtctgcttaagcttgtcattaagcttgtcacacctagctgcaagggaatcaggtaaatgtgttttattagccaagtattctgtagccaggaaagccatttcaggatctatcattagggttattatttgttttgatttgatttatttaaaatagggcctccctatgtagtattggctaccccggaactcattatgtagactattctcgtcttcaactcacagaaatccttttgcctctgcttcccacgttctgcacttaaaggcatgcaccaccatgcccaacaggctctattcttaaggacagaggagtcaaatacttggcaacaggctaacattctgtattgtaaaggtaggagaggaaaatgagatgaccaatacatgttctccattaacgcattattcttcctgagcaattagagggcagttttggaatgttcctcccacctttcttacctgctggctgaccacatggaaaatatttgtgggatgatggaagaggaggtggggaatgcttctcgtctgtatgtgaaatcgcccaagagtcaagctcattggactcagagtgtgttcagatgcctggggaatacttccaacgaaaatactgaggggttgggggggtgggggtgggggaggagtaatttcaggttctggaaagaaatgacagcatcagtttcctttccccattggtaaacttttatttcatctagaaactttgttgttgaacttttactttgaaaggactagcaggcgaaatgggctttgaggcttttagaaaggagcacagtatttaggacctcgtctgagccagatctgcccattatataaaatcacttttctgccacgacagagctttttcacatctgtttatacttagtctctcttacccagagtggaaagatttatgtaaaaggagaaaagaactctgaatgtatgtctcgcatcagtgaaagcggggcctccggcttaacatccatttgaagtacgtagctactgtctaatcatttcagttattgtagaagtagccaaatgaagctatgtccctggaaattagagatgaagatgtggggaaaacctacaggtctaagaaggcttgacaagatcatcaacattagggagcgtgtgaagggtctgccatagacatttggaatgcaggcaaaggtttcatttaaaatgtctcaatgattcgtgacatactgcacctggatctgtataataataaatgtctatcatggttcctcaatagtttctcttcgttttattttctaagttagttgcagtttttccttctcttaagtgcagacgaaagccataggaacccgtctaaagacgtatttagggcacacacacacacacacacacacacactatatctagatagatagatagatagatagatagatagatagatagatagatagatagatagatagatagatagattagatagatataaagtggaaatagaagttccaagtccactgtgaggagccagggatggcactgttccatgtaagtgttccctggagacatttgatctctacagttgtctggcctggccctcttagactgcactgtccaataaaactattgtagaactgtttaaatccaatttgaaatttcaaatagccacataaaaatgtaaaagaagataaagtcagaggtagagtgcaagtttagcatttataatactctgggttctatcaccagcacagactatcagatgataaatgatagatgatagatgatagatagatagatagatagatagatagatagatagatagatagatattcattcctttttagtaagttcaaatagtctttgaacatgtaatccacataaagctaattacaaaataaatatattacatggatttttatatcatgtctttaaagttttatctgttgtgcatattttaattcagatcagtcataagtagctgccatattggacagtggagccttacaagactgacccttcccgctgccttccaaaacatgttcacatttagaggatggactctgccaacactgcctaagccccttcattttacaggtgaagatgaccagatctagagatgctgggttgcttagaatcccatagccattcacatcagaagccccacccttttgtctgacttcaattgctttcatcattctttctttccttagatttgtgttgctgcaactactcactgtgagactgttgctgttggttaaatattgagccaggagtcttaaaaacatttggtccactcagtaaagccactgtttgatttggtggaaactgttttgagcagagtaggtagaactaccaggcacattgacagttctccatgagatagtaataggaggtgataatggggacaggggtgactttatgcttgttggtgttgctgtgggcattataggagtatgtgacttcaaattttgaaatgctagctgcctgcttacaggaagggagatgagctgttcccatgcaaagtttattgtctagttgtatgtataagcctacacatgatgaatatcttaatgcttaactctctctggaaatggcagggttaagcttttatatttcatatttttttcttgtattaggaacgtgtgtgtgtgtgtgtgtgtgtgtgtgtgtgtgtgtgtgtgtgtgtgtgtatgtgtgtgtgtgtgaatgtactcctatttctcactcagttatacttaaagtgtgatgatttttgacaagttaatcccagtacactcctggcatgtaaagtattttcagaatgtaagcccatgtggaaattcgttggcttggtatgacgggttcgggcaggggaggcatagtgtgatcccgtggagtgttcggagctgccaagtatttgttcttcggtgtgaaagcgtgcttgacgggtggactttcctagctggaaggtgctttgttcatccttcctaaaacatttatcagcacggatgttgtagatcgtgtaagagagtcccctttattcatgtgacttagttcagtgatcttagatttagagttaagtttttgtgttccagggttgggactaattcccagccatggcccagctttacccacaaaggaactaccgacctgtaaggatattcatttgatgcgtttgcttttgttcctggtgccagtcattggattttgcctatagtgctttatgtggctatacttagaagttttatagcttgtagcaatcaggtgaaagtacagggatatggctgagtactgtaacttgcgtctgtaatcccagccagaggcaggaggatcaccagtccagggcaatttgagctacagaggcaaactgaaaaaggaaaagaaaaaaaaaaagagattcctttatttcctttggccttcatacacaaatatttaaattcttaatgtacggttttaagtcagccccctacctcccccaccttggtagtttgcatagtacacattagcatttgaaacaaaagttttgagctataagatgctcatgggagtcattctgaaatatgtttaaggtggattgattcggaaaggatgcaaatccaagttaggctggctgaggcctccccgcttctttagagggtgatacggaaggtttgaggacccagtctgcttcggtcggagtgtggacagccagtgagggcagtgcagcaaaaccgtgtctcagaatcagaaagttaaaaaaaaaaaaagagggcagaggttatagtggagagacagggcatttgcttagcattcgtgaggccttccatttaagatctctagtaccctgggagaataaaaaatagtcgtaagttcattgtgggaaagtgagaaaaagtgtataagtgcttgtgttctatccacgattgcttttgttgttgttgttgttgttacatcatatttaaaagcatttttgtaattatgccatagattccatttcatatctggtttgttctttttatggttaaattccatccctcataaattctttgtaattataacatttaaagggtgcattcatttgtttaaagcaaccagagctactcacttgtacgtgtggggctttgctttgtttgtttgcttgttagttatttaatattttaacagagggggacgtctatgtgctaagtaagtggtgatactcatttgtcgagtgatctaaactgctgctgcgctcacacttcgctataatatgtgcttaaaaaaatgagatgaacagatatcatacagatcaacagggatttataaatccccctgccaaccccccaaaaaaagcaagcaaaaaatctggtctgctgattgaaagaagcgataccccccacttaacagctctatcggcactcgtgaaggtagaagtttgtctgtaagaagctgttagacttgacaggcaaacctagctgcgccttcggcatacacgttagtgatattgtgccatcagcttactggagcaactcagtgggaacaggattgggttgtatgatttcacaaatgtaaatagaacatcctcttcctcgtttccttgctgctaatgtctctcttggtattatgtggataaagagaaaattataactattaattctcgggagttcccaaaggtaagactcgaaagccaccaaagagtactatatttatctttaaattcaacaatgaggtgaaatgctcttttcagaggtcaccgtgtagaatctggagcccacttagccagacccacgtcagctttattaaggggctgcctacatgcccagctttatactactgcgtgttgttgtttacttatttattctgctggatactgtagttgtgttctgccactgagctacacccccaggtccatgttcatttttaataagataatactataaacatatagtgaataaatgccagtacagcacacgatagataaattaataaaactgaagttccataccatcagcagaacaggaattataaaagatgacttcagtgtaagaggcaaagtcatttgttgagccccaactctacgtgaagaagaactcatattcaaccatggggggaaaaatgaaaagacatgaaatgcctgatctctccaaacttctgcactactgagtagatagcaagccaaactcaccaatcgatatatcctgtgacactggggattagtctgtggaggggaggggcgctacgtaagcaagtgaagggctcaagagacaagtcagagtcagtacgagtgttcatgggaacagagaccaggcactttgctgtatggattcttttgacccgaaggcaacggagaaatagcagacacttgaggcttttacccactcctctctgcctacatgtggatcaatttccatctttgatggtgtgagctgtatcaggaaggagtttatcactgatcccgtggacatggcactgaccttagtctacagaagcaaacccctggtttcttccatcttttttttctttgccaccagtagctgctcttagcagctccaggtctcttagactgtgaatcattagccttccctttgcatgtcaacatttaggatagtgaggaatactggactatcttatagccatttcagagtctctggggggaataggaaaaggaaagaatttgcattaaaagtcagctgatctgtcatgtcagaggtgtgatttgttagttttgggaagaccattattctttatggtacatgtgaaaatactgactgtgtaaagaagccccttatccgtggtgagaacaatggtaattaatagcagatagaccttctagaagtcagttgtgcccagaagtgtgtttcatgtaatcccccgctgaatgggaatttaagattggaccacatgaacaatctgtccttggtgcctcctgagccacctctgcactgcctacgtgaatgatgggtgggactgagctagtgggtcctgtcgggccagacatcctctccttgaggaagacagccttggggtgggatggactgataagaaggcagactgggagtttgttaagccatcagccagttctcaactgctctggaccctccctgcagcaggagggatgctgaggagtaagacctcctcccacctccactcacactcgctccttggtgtcttctctgcctctctctgctcgcatcacctttttcctagtcgtctaagtcagcggttctcaacctgtgggttgtgaccccattgaaggttgggcaagagatttttttttttttttttttgcaggggttgcctaagaacatcggggaagtacagacacttacgttatgattcataacatttgcaaaatcatagttaggaagcggcaaggaaaataacttgacggttggctcaccacagcatgaggagctggttggagtctccttctctttatcacagctccaaataagggaaccctcagaagatctgggggtcactcagaacatgggtctgcagatcatgcaagatccagattatgaatttgggtcctgacttggcacagcccagtagaaacgcggctgtagaggaattattaactttcttaagcttccatttccatatctacagagtatttgttaatagtgctgttaggagccatgctgaattaataagaactacaaagataacatgtggaaggtactgaatgaaggattaacatggctcttcttgtcatttcttggccccttcgtaacagctcttttctgacctttctatacagtcctgactgtacaggccagtgctgcgtcccctttttacaaatgcaggggctgagaagagcccatttgcccaaggttcttgtcttctgtttcagctgctgtcaaacagccggaaggcttccgttctaggcgaattccctccctgactgtacctgagaccaggttgttaagattttccgcagggcctttctttccttgcttatccatccttgcagttcttgaccttcttgaaccctacaaaaccagcttaggaaggaatctaaagcatgctggtcacaacgaggaccatttccctgtccttccctctgattctccacagttgaccaggcgccggtgacagccttggctgcttgaaccagctagagagagccacggaattccaggctgcttgctttcaaagggctccactaacccctctgaaaacaaagggttgtttatcacatatcaaagcataccgggcagggataattgagagatcttctgataggtcatgtggtttgtagtctctgcccaggcttctggagtgggtgggccgtgctcctgcctcaggtagcagtgacttctgtctgccaggattagttctgtgtgactgtcctgtaggtgtgcatagcatccgctcaccatcaacactttatatttctctgcctaggtccctagaaaatagattcacaaagaaaaccgtcttgtactttgtatggtttcaggtgactctgatatttcatgaattcacaaaacccgagttgaacacagcaccacctagtctctggtctaggagaggtgttttgttttttcttttcttttcttttcttttcttttcttttcttttcttttcttttcttttcttttcttttcttttctttcctttcctttcctttcctttcctttcctttcctttccttttcttttcttttttttttttagaatggaagtatcaacctgggttgggttaaatgttttcgagacaagccccaggctgcaggagggttttgctgtttagactctagaggaacaagccttctcttctcgccattgctttgccctgaccctgcatgtgtcaggccctatcatatgttcggctgtgtgatcctgtgacacccacatcctgttgctggatccaagcgctttgaggctgtattaacgcagattaattgaacagttgccctgtgaaaacagatgcccttcgccgctcgtttctaataaattgtcaagccatttaaaagacttccccttgaagaagtcatatctccccgagaagctgaagcaaaagtggaatgtttatgtcccaaattagtgtgctatatttaaaaccagtggcctcggcctgaccaggacataatccttcgccgcttaatgaaactgccatcctgtccctctgtattatatagtgaagttggttctactttctgtattccaaaccagaaagccgttgtaaagaactagccagaataagacattagtcttcagctatttgatgttttctttataaattaaaattataactgactttgaaataggaagctaagcctggcctcccctgaaccaaaaactgaaattttagtaacattttgcttacgggatattgtaataaaatgctctttgcttaagataaaggtatttgtccagtgacattctgagttacagaaaattgagaatgtattatagataatgtactatgaaaccagaagaacattctctctagttgacaaagatatgcacaatacaaagatccaggtattgatctgatgctgttcagagatcgagaaaggccgagagcaaatcctatttcaaagtgcaattcaagtaaaattagattcagtgagactatatcatttacccacccttgtagtaaataataaggtagaggtgcgagtctaagctgttacctaaaggaagtgaaatgacccagagagatgagcatcccatgacctcccaaatggaatcgaagcagttgaacttgcaagagtagacactagatgccagtggatggggtaaatgggagatgttgttcaaagggtaggaattcgcagttagacatgggtacatcatagagagctggagtatagatattgtcactgtagttaataataagtgttatattcttgaaataggttttaagtgttcacacacatatagaacagtatgtgtggtgataggtaacttcattagttaattgttatttaattacttaaaattatatatatgtgtatatatatatgtatgtatatatatgtgtgtgtatatatatatatatatatatatatatatatatatatatatatcaaaacattatctcgtgcatgttggataagataacttttatttgctacttctttttcacaaacccaccttgcacttcatttgtaaagagaagtgaagtccctaacctggagggttacagtaagaatatcgtgtaggcttcagtaagcatttgtcattactgatgctgctgtaagccagtgctcatgactggctcctctccccttcctctgccagatgttctcagtggctctctgttgatgcatgcagctgtgtttctgagggacaccatggaatgtccttaaccctctgtcttcaggatcagtgtttatcccacagtaaaagaaacaaatcaccatcaaggttgctttgtagcaacatacaaacccccaaagctcacataatgactatgtgacaccatatgaatggacaccatagccaccatgtaacggctgatgacagatactttctccccgttttagtaacactctgctgcttttctgtcccatcagagttccatgtctttgtattatgtgtttattagatcctaggcatgatgtatgcagtactggttgccatcaaaatagattgtagagtttaatgggaagtctaggagttgacatccgtaccctacataaaaccaaccaaccaaccttttaaccttgctgattagctatcattgagtaatagatttcccacctggaccaccacttatactctactaattctaatccagattctgtagctctgttgtctgtctaaatctgaattcttttctcttgactccatctgttttgtcagagcctagtgtagaagcggtggactttgagccttacatggacccaggccaacagttcttctccccacatccggagaccaggctttgccttttacaagaaggaaactgcctctctgttcccaagacaaagctccctcgactatagttgctgcatgtttggctcagaggtttgcacagtctatgtgtataggcaggccatggccttgctgggcctgctggaagatggctagctctcgctggctaatagttgactcactcaccgtgggatggaagctctggcctggaccagactctggtcagtgtctgttgatctcagggaacattccacagctgctgatgtaactcaaatgactggagccaactcttctggaccggttagagggcttgcctggaccagttagatgactggctgtcactcagtttatctgggggaattctgtgaagtgagtgttactttcagttcctccatggtaaggggaacttctctcctcttatcttctttttgcaaagtgtgttttttataaaaccaaagtagcatctttgggactgtggtggtgccccgattcccgattgggaagccttgggaagaggctgcagaaggatccagagttcaaaacagactcagctacagatgttccaggccaggccaggtgacatgaaacggtgtctcaagaaccctcaaaataaaatcatcaaaaatagagatggagtttataaacgatgtggctactatttcatttggtaccctattcaacatgatcctcacagtgcttataactccttttgcttgaactttttttttttctcctgagctggggctcagaccagagccttgtgtactaagtaaaaagtactgtaccagtgagagctatcccaagactgaaatatctttttattgagagattcctcatgaaatgcatactgaggcttttgtttgtttgcttgtttttctaaatgtgattgcagaaccagataatttgtgagactgcccatggtatgaaaagattagttttcctagtctgggtgtgggccaagacctattgttgtttctgatgcaaacccaagaccaaggactgcggttgcaaacttacttatatgactgccatgttcctaaaaaagatttttagaaacttaaattaaaaaagcttcaagcagcccaggcacagtgggcacacctgtcaccccagtacctggaaagtcaaaatcaggagttccaggtcatcctctgctaggtacaaaattccagagaaccctgggctagctacctgagactgttttaaaacctgcaacaaacaaacacaaacaaacaaacaaacaaaaaactctcacataaaaattagaccaatagaattaggaaaacaggccactagataccaacatacattttgttactaattttaaaactatcccttagatgcacagaagtacttatcagataactgcagcttaggggtcgcccgagtttactaggaagccatctgtttatgggacaaacatgtatctgctgtcatcaggaaggtcactggggtagctgtgactcagatccactaagggaagggacagaaataggactcctatcttttgtatctctgggatggtgaccagagaggtttatgttgttgctatgtaggccctttttaaaaactccaagctgtaaatactgaattttagaagcacatcgtcatggctttagaaaaacaacggtctaggatttccgaaggagcttgtggctcctgcagctattcctgatttggtgttaagtttctgttcttaccaggtatcctgacctccagtgtgggcttctttcagaacacttcaattaaaaatgtaattattagtgtggcattcgtgagaacatgccctggtagagctttagggatgagaagacaacgtttgaaaattgattgtctccttctgacatgttatcccaggttggaactcatgttcccatgcagctcaggttactaggggtgttgctaagtactttcacctgagttatcttccctgccaccaatcagaactcttagcagtcaaaataaaagggggaaaaagggtttcatttagtttttaaaagtcattgtgtttttttcaagaaaaatagagattagattaaaaaaacacattataaagtaaattttaaagccctctttgtttttattgaaacttgtatcaatttctttatttggcttaccttgggacaccaggaaaagagccaaggtttcctagaacacagcttgaaatccagtgttccaaaggccccctagtctgtgctttcattttggagcaccattttttaaaaaaataaacccagatttgaagatgaagagataagctgactggccttgaagttagggccaaggcctaacaatagctttgaaaccagttttatgttttcagaaaccaccaaaccagccaggcatactgacacatgactttaatcctagcactcaggagacagaggcaggtggatctctttgagtttgaggccggcctggtctacaaaacaaggtccaatacagctagggctgttacaaagagaaatccccctccaaaaaaaaaaaaaaaatcaaaagaaaaagaaagagaaagagaaagagaaaaagaagcaagcaaaaggaaaggaagaaagcaagccaccaagccagccttaggtccagtgtcgttgatcagacagttcatctgcgtttgtcaccactttactttctgggaaggaaagcagggattatatatatatggtggatagagataaatgagcagctatttaaaatgccattttttttgtacttacttataagtcaaatctgtgtagatactaaagatgagttatagagaccagacttctgttttatacatcaaatttcaattttttcaacagtaaccttattgagaacctacgtgatttacttaaatgaaaaacagctttccctagatcctcatggctttaggatggagcctagtggttacacatttctcactgccttagttttctgttccgtgatcggtgatccctgggagaccttttgacctgtggcaaggcagcacagcatggtgggagcgcatggctcattcacctcatggctatgactgggtagaaagaagaagcaaagattggagtctccacgtcttcattaaggacacacgcccaaagacaggaagacctgcaagggaaagatcaccagcgtggaactctttctcaaaagttaatccagatttcgccatcaaagcctctgccttcatggtgaggcatatgcgacgtgcctctgacttggtagagctaaagacaggaaaggagaaaagcagaggggttgcggggggaggggcacttgtacttttcatgtcttccagccaagcgcttgcacttgccctcttatggaagactcgccatccggacaaaggagggtagttacggccaaagaatgaagttgctgagtaaaatggatacccttctctattttttttttccattttatcctggtacctggcaaagaaaatggaaaaatgaaaatttggttggaaaaaagtcaaagacgcgtgtaattggattagggctggggattgtagcaccgttcagatcacttggctagcggtgccctcagtttattcctcgacattggtgggggcgggggcagggggagcaggaagggcataaagggcatgtgaaggcagaaatggtgggggctgaggagatagcttaacagttaaggtcgctcttcgcatagtcaggaggagcagagtttggatcccagttcatttcacagcccgggcttacacccatagctgtaacttcaattctaagggtcagaggcaagaagaccagtgagcattcttctctccaccccacccccacccccagcacataaaaagtctcagagccaagaaaggacagtgcctcaaaggaataggcagaatggtggaggaggagggacctacagagcacatggatgcatgtactcacacagacagacagacaaacagacacgaataaagtatgcatgtactcacaccaacagtcatacaaataaagtatgcatctactcacatgcatacatacatacagacagacagacagacagacagacagacggatggacagagagacagaaaaaaataaagaagtcttttagcagaaagagaaattgttgttcttgatgctggaggcagggggaatcacaagtttaaggctagcctgggcttagattctgtctttaaaaggaagagggtgagatggcttagtgaatagaggttatcgcctctaatttacctctaagtcacaaaggtcataaggcattcatatttatgtctggttttcaacttgaacttcctagtagtttggtcagatttttaattcctgagtaagaagttggaagcctctacaggtaatcgtattagccagctccaccttcatgagaagctaggatctcgaggtaggctaatcttggctttatccctggcttactaagtgattatacacagagattagttctaataagggatatctcttcctgactacaccttggaagcatgagtgcaaaggtctttaaaactttggagctaagcattgcagtccggtcagggaggcctgatggaatgctaaggtaggctgattcctagcaataatcttagtgaacgaagggcagtccatttttactctgagtccactgagtgcgtcagacttgaagggtttatgaaatgtcgaattatcttgactctgagaaaaatggtcagttatagttttagaggaatctttataaaatcctgggttaaaaaaaatgtattctcagtttgcattctgatttattcacaatagatctgagtcacaggagataatcacccctgttgtgtggggacccaacggagacaagtgactgtgttcccctggaatcacagagaaacttagtatgaagagcatattgttttataaaagaaaataattatgcttcctgttataatgcctgaaaaatccatggaagaaagaatccaaggaaggctactgaggatcggtgatgatagtagtagttgtagtgatgaggtggaggaaaacattgccaacctcaccacgcaggctgggtggacaagctggaagatgaagcatgattgaatgctattggacacttgcccttaagtctgtcacacattgttgttctaagtccacagggtaagcacctatcttcagcgagttgtcatgagaagacaggattttatacagtgtgtacccctgtagattcaagtttcaagtgggattttttttccctgccagttttattagaacctggccagttgcctcttaactgctaaacactaatactttggaagttcctatgaaatatagaataaaacaaaaagcagaagcaaaggtataacaaaacaaaggatgggcagacacctgctcagtcctgtcttcactgcatttgaaagatccctgccgtgtgactccaagtcagtggattagagacagaaacttccgcttttcatgttcaaagtcaaggtcaacactaagttaaagttctgatgagggacaggaagggaaatttattatgagttatctatttaatacatagtcaaccagatcctactgggtggtgaaagctttctcttactagttatggttggtttttctcttattttaatgcttaattagttgctttagtccaaaatatgtgtaacaagatggagtctctaatctgttactgattagatgagtctactgatacgtcccctgactaatcatacataacaagcaattagcacactgaaaagcaatctggatctagcattacacaaacaattacgtcagttgctgacatgaaaatcccagctagagtggtaataataactgaatgtgtgaataggttctctctttctaggctgccagtaagttacaaccttttcttgagttgggtttcagcaatgaaatatagtgaacgtctattgtagattagattgaagtaggaggaccagttacctatctattttactgttcttgacgtcaggcaatccttagggtcactgcacaaatatttaaaattaggtagagacactaaagggagggatcttttctgagtcaccacagcttatttctcttagaagtggtttgaagattcaatgcaaagaactttgcgctgtggcctaatttagtgctgctttcccccttcaaacagaataggaataacccagtgtttatgtgctctttgggtaagcactaagccagaggattccgtacttatagaaatgagtaaatatggagatgctgaacaagtcaggcagaaagcacaattgcatagcaggcctgtgggaaatgaacaatgggggaccgagtctataaatgtaaggaagaactgataataacttttgaaaagaatattttatacatccagataatctaattcattatattaggacaatgttctttttgtaggtttttttgttttgtctttttttttttttgtcatgaatgaacgacttgctgcaatgtctaactaaggtatatatttcagcctgaactttattcagaacatgagcatgtggcattgctaataacttctctgttccctttaaatggaagcttctttgatgttccttaaatatcatatgtcaagcatagttttttttttatgatgatataatgtcttatcttgatgagattcctttctaaatgtccctgcttgcaagaagaagccttcctttagtggctcgtcgcatcagatttttgataacccagacctggatgtcgtttcatctcaaggtcataattatagatcgtgtttatgttgcttctgctccccttaggagagctgttggatctttaagatgacttgaatttggtgacaatattaagtccatggccattgaattgcttttcgattcagaggggcttgctttgattagggctttttctctagtttatcattccttttggcttgtataaaatattgtcccttcatacttacagttgtacataccataataggtactttcttttttccataatgatttaggtacagacaaaactaataatgctagtttgtcaattttctcttagaaaaaaggagtcgacgtatttaaatgccttgctgaacacactgctttctgccctggtgtctttaagaagttgataagaatccccatgaactggaatactgttatatttttgctagtaagccgtggcattggtaaatagtgcagtattctatttcatggaccctttcactgttttattgatgacgtaaatttttattgccccaagataggtgtactcaaaggggaaaccagagtttctttttggtagtaaattcccatctaagggatggttttagctgcttaagcagggtcccccttacccccaccccaggcttcagatttgttgtttcctatgatggtgaggaaggaagggagggggactgctactaaaaataagaattgctcaatcaaggtgaagtctctgtttgggtgttttaagttcacatacttgtgctgtccagactcgaatgaatatggagacaggaattagccttcagcgtagtcttggccaagcagctgagtcatttctgtatacatatcttaatagtttggaatattttagtgaagtcagaatacctagaacagatattcggagttcccagttgtataaaactcagggaggaccttgactttgattctcagaactttccaagtgttaaagaagacattatgctggacgtagtggtcatgtctgtaatgccagcactggggagtctgaggcagaaggattgggggttcggttctagcctgggctatttactgaacgtctatcttaaagtgaaagaagggttattagtttacgtgtgttgttatagtcagctccaagacacacttgtgttgggcaagcttttctaaaggagtggggagtgcctccctcttcttttttctcccctcccttgatcttccttgtgtctcctccctctctggcccccttttcattcttccattctctcctcctcggctccattcccatcactcccctctctcttttctttcaaaggctcttgctatgtagcccatgctagccctttcctcatccccctgctttccttaacctccacagtacagtgctgtgattccaggaacatgcccagcactgtgccagcctcttgctttttttttttctacaggaaaaattcctttcctaattttcctcttcgtttccttctttcccttcagtcaccccattccacactccgctggggatcaaacctagggcctgtacttaagttctgttaccaagcaacggagggagcagcatccccttgactttgtcatctcacctgttctgtattttctttattaattaatttatttgctttacatcctaattgtggctaccttcctgtcctctcctctcctcccctcccctccccccttccctcctatccccatgattctcctgtcctccctttctcctcaaaagaggggaggcctcctatggatatcaacccaccttggcatgtcaagttgcagtaagactagatggatcttctcctattgaggttagacagggcagcccagttaggggaaagggatccgaaggcagagagtagagtcagagacagcccctgttcctgctgttaagagtcccacatgaagaccaagctgtacatctgttacatacatggagcagggctaggtcagtccaatgcatgctctctgtttggtcagtctttgtaggcccttatggacctaggctagttgattctataagttttcttgtggtgtcctttatctctctggttccttctatccttcttctttgttttgttttgttttgttttgttttgttttgttttgttttgttttgttttgttttgttggttctagggctatggcccaggactgcacacacataagtgtaccaccattgagagtggctctcatttctcatcagagaagtttttctctgcagacaattatagaaaatcacacttggctaaaaggcagaaaacaagtgatcatggagggctcagctctaatggacccatctacaacataatacatatcttgcccccaaggctcaaggaacctcttggaacagtggctagaaagacagtaagagccagaggaccaaaagcgtgaggtgagattgtgtctcctagaactaacagagaagctacacccaggaaatgtcaacagtatggtcacctgaacagggatacggccactagacatgataaggtggaaggcagaaatttcacagaggtcccatctttagacaaataactgtagacaactaagggatgctaagaatgtgagatggagtcttcactagccatgagcctcttaattagtcatttcttgtcttttgcaagtcagtgccaggtaaatggaaagaaactctgtggtcctcaaataatgtgtctgtctttcacatgactttttacaacatttggctcgatatcctttgtgaccatatgaaatgccaccatccccaatcttttccatgcattaaacagcagtgtgtatcctgtgttttaaacaagacagagaggcgctctgcctgctcctaggggtggagatttcctgcatttcactctgtccttctttctaaggggaagtttagccggttggccttggtatggtattcaccatgtcatgtggtacccattagcatagcggtatttaccaaatagtaagattctggccattacgtcatctttttacttagctgctgcaggacatgcgtaacacgcaacgctactttgtaaagctctctgaagccttctctttataaaaggagcctggcattcaggagtcaggctgacctcccttacacagtgtgagacaggaggtgatttgtgttctctactgtgaaatcagaaggacctagtgctctgtgttcgggatgcaaagcaccagctcgtccctccccgcaggagtgcacttcagcagattctggcatctgagctcctgccctttctcttcttgttctcattcactaatcctctttccttgatgccattttgttaaattttgcaagtgtcattttggaacctagagatggggtttgaatatatgcatctatcatcagtcattttatatttattttgtaaaatgaaaacttttttttttttggagaggggaggcagtgtctttctatacagaccaacccagcctcaaattcaacgttctttctgaccctcagccttctgagtgctgacatctgtgtgccatccggtctcgctggaactttaaacaaactatctttgttcattttacctgtattgtctaaaaggcaaaacagacccagccaaataataaataaataaataaataaataaataaatatcgagggtttttttgttttgttttgttttgttttttgtccttgtaagttcctgaattttatttacatacacatttgaaattcttgcgattgacctctgaaataccacaggcctttgcaacctcagattttctcagcctgcttacttcctgtctcctctcctcgtttggcatggtggctctgcaggagttttataatagcactcaccacttctgttccctggaaggattcttttggttttatatactttacttaaatactagttaagttacgattggtcacccgtttcaaacgtcctagcacgccgtagcccgtaagttacgattggtcacccgtttcaaacgtcctagcacgtcgtagcccgatgtttgctttaagtatggctattatttcaacttcttaaaaacttgttgctctgtatggtagcaagatatatgtgtacataaaagataccttctaaaactctttaaacttgtctctttataaaaggaacatgtaacggaggggtctgggtgggctctgccctactgtgtaaatggacctcctaggcgaatgcatttgagaaagcttggttaaagtgacccaacgcttctactctccagacacctaatgaaggagcttctccccgtgtttgtaaacagaatgcgtccccactccttgaaatggcattttctagaaaccattttttgagaacattcatttaggaattaagtaaggtctatagtcatacttttaaaattttccaataccacttggctgttctcagtatagataaccacctaatgatagatttagcaatttagcattaataagtttatactaaaaaaaaatgggtccataacagaagttctttataagaaacaatttttctttattctattattttcagaatcttggtatgttagccttgaatccatgccctcctgcctcagtttcaaaactacagacaccagtggctaccgtgcccagacctaggacaaaaattgactgctgtagctacctagatgaaccaagacagccttaacagtttgaactgtgctccttcatctcatttagaattagtgattcactgcgaataagctgtcaagaatgggagttcatcaaccacgtattagccaccagagctcactttgccgttcaactgtgaattaagggctcggagatggtttaaaataccacacggccttggtgagtcagctctgccacacacactgcacttgtcgcttcgtagccgggagtgacgacatatgagctgcagtgtccttactcgtttgtctcctggagacaacttggcaggcagacatcttgcagataaatgaggaaagattgtctatttcaagtggcataagacattccttaaagcagtgtgtcatatctgcttatacagtcagcattttctgtggagcagaaaatctcctctccggctccctgggtacacagcaaacatctttgtgtgggtagcgtccaggaggcttcagtggctctgttgtctgtagatgggtcaggaaatttcttgtgcctgcatacacttcttttttttcttcttcctgttgaatgcaagcttggtcaatctgggtagcttttttaaatgctcactatacatctcctgtgtattactgaattgtaatttaaggtcaggtattgagaactattttagagagaggaactaaggatgaaaatcaaaaggcttggttggactggatgattggctcagaggttaagagcactgactgctcttccagaggtccagagttcaattcctagcaaccacatggtggctcacaaccatctgtaatgggatccgatgccctcttctggtgtgactgaagacagttacagtgtactcatacacataaaataaataaataattctttttttttttttttgatccttaagacttttaatatgtcatcatttagtctgtcatttctcaacatgctttaaaactacaaattacatatttttaagatttatctatgtacctatgtacctatttatctatgtatctatctatatatctatgtatctatgcatctatgtatttatgtatctatgtatctatctacatctatctatctatctatctatctatctgtatgtatgtatatacatgcatgcatacatatgtacatacatacatacattaaatagagaaggaaaatttaatcaatttttatgattatattttcaacttaaatatatataaataattcttttaagaaagaaagaaagaaagaaagaaagaaagaaagaaagaaggagagagagagaaagagagagaatcaaaaggctctctcttcaaagttataaatgctaaattctaaataggaccttttctcatgatacaaacatacccatctcttctgtgatttgttttgttttccagtccctagagcaactctgaaccaatactctgaattttctagatataggcagtgatggattagacttgactaaagatgcaagacatggggaagtttctggaaacattttttaattcataagtgttcataagggttttgcattgggtaatcaaatgatacaaatggtatgtgtgcatatggttgttatcccagaacagtcaagacattattcaaatagtttccagtgacgtcgcttctctgagttggtctaaggcacttaaagaaacaatgactatttggaagtctttagtgacaaagaagactccagctggctgtgttgatcttggaaccaggaaggacactagaatgagatcccgtggatgtgctcagaagcagagaccagcccatcgcctacagttatgtagggtggttaagatcgcctgcacctgttcttgactgataaattataagttgatcttcacagaatgaacacaataaaggggtgtgtccgttactgtatataacgtaattatggcctatcctgtgtgatcacacactgaagagattacctggctttttaacctgtgaatttggatcattggagtcagagtggggcttcatcctaatatatttgtaatgttttatccccctttgtattgtattgtaggattcacggttataacgtcacattttgtcttttgattaattaattattttggtatgtatgagaagcagagactcgtgggctcaacctctgtttgagtacatgttggtatttggttttcttgttggaaattgaccaggatttatttcatgcatgctttacacgagccttaccactctacctaagactcaaggccaattttgatgtattctcttagaaacacagaggtaaataataaatgagttttctcctaaagatttaaaagcttagttcagaatttcaacgaacacactgttgagattttccagccaagtacttcttaattctctatttggaagggtttcctgggagaaggtggcctgtgggggatccctgacgtcttcatggtaggtacaagcagggccacccatattgtgatgaccaactatcccaatgaccttggatttgcacatggaaacaattctggaagcaaaatgacttcagaaccatgtgagttagccagtggagagccactgcatggttgaactacacatgtggaagcagtggtaagccttcactgaaaactacactgtgggtgtaaaaccgagtgtttgtgagaactgaaaagccatcttcctgagggtctgagaaggatgctcttgctaattactgcctccattttttttttacttagaatgatatagaatcatgtagagaatagccccaggaaagaaggagccatcgtaatacatggtgccatcattttaaaaatcacagctatgtgcattttgattggtttattcaaacaaaagtggctgtatcagtatcagtgtggtgtgtgtgtgtgtgtgtgtgtgtgtgtgtgtgtgtgtgtgtgtgtgaacactctctggatagattgtgtagtaggacttaaatcttcctatcacctcttatactccagagaacgatgtagcttgagccccatatcacatctccatctccatttcaggacttagcctctatagatctgtcagaacatccctggagaacagggcgtacatggtgacagtggagttccttctcctcctcccccccaccccccgcctgtcataggatatggctggcatacccctccccctgaactctccagtccaaaggctgggctacccttctcctctggctcttttctgtatgatccaatggtccttttgtggcctcctgtccttttgttgtcctgatcttccctctccctttatggctctcctcacactgccggcctcatctttactctgggctgtcccagatgtttccatctctggctatgctctccctcatatttacagtaaactttctcctctactatacctaggagcagttgtgtctgccagtttcctttcttacgttccttctcctgcaatacaattcacttttgtaggggctgagaaggggcgggctcatcctcttacaccaatgagcgtccttctcttctggtttttggctagggcagtagttccatgtgtcttcatttagtatatactcaaggctgcctagctgctcgtcctgagatgtcgtgactccttcccacactctcctgtgcttcttagctgctgcagtcatcaccgtgcctaatccatacaagtgcccccgtcctgtggtgtgtccaatgagacaccaccatcctacctttctttattctttcagcactttctgttctgaggtgagccttgtctgagcctgtaccactgggttggatctccccacagtccttttctgtggctatgcttactgccttggaaatgtttacatgatcctaagtcaccaaaccagaacttccctgaaacttcgcctccgaccgaccgagacaattctgtcctgtctactggaagtggcaagggctccgtagccatcagcaccgagtttgagtttggcttatctgtcagcggttggtttcccgcatcatcctgaaagtattttctgttcactagttcactagcctttctttcacttcaagtgttaggttaggagtggaaatctcttgagaatccctttgtgcagctgaaggcatctcagctgcaagaactaaaacaaaacaaagtagctgattgggtgcttcattcaggaagtatggctggccactgtgtttgtgcaatcctggagcccagtgggacaagcctatgttactcctctcaggaatgtgctattcgagcaccaggaagtgaaccgagctgcctggctcagaaatcccccttgcgttttgagctgttgcctttagaatgttctaggaagagcccgaggtcaggccaagttcagctgcaattggtaatggcctaagagtgaattctgtgctttcttttctccattggctcccactgcgaaaatcttatatatccctaagtcggggtttattttatatcgttgcacagctttgttaatatcgacaagttctttgcattttgattttaatgttattatttttttacgccgggcattctttagctcttgtatttattgtgggagggaggcaggcatgttgtagagagcaaggaagttgtcacaggaggtggagtcgcgtttatcttgtttgtactttacaaactaaacacaagccttcgctctgcacttacaatgcttagctggatgctagctggcagtaaagacttcactgctcttatcacttttgacttcaaattgccccctaacacaaaatagagtgttgttatatccctttcaaaattatagcccccaccccacccccccccccccccagcactgtgtttctgagagcctttgttgccaaaggaatggcaatttgaaaaagtggtttttgttttgctttttggttttggtatggctgggggccatgaaaagggaggcatctttgatagtgcctgactctaagttacttgagaaggatagtctccctgttcttatcaagcacatagctggaaacagaaacctttgagtattctttacaaccccggagaagaaataatcttggcttaccctaagagagataaggtaacagaaagcgactggaacaatggacaggaatgctgtttttaagtgatcaccaattttcacatggactcccgtattcgctctgagtctttcttgtgcccacaaggcagtttctgctacacccagtgcccctgtggtaaaaatacaataccatgagagttataaacgcaggggaacagccgatgagccaatgttatgaagctttggaaagaattaaaccaagggataaaatgtaaatatttgttctgctcatgtaaaaaaaaaatgtttcacgtcctcatcctgaagcattccctgtgactctggtacacatagaaaggtgacgtcctaaggccacagattgttgcttaagtgaaaacccagattcacttcagtcctgtctgagttggtcactggtctcttggtatctttacatgaatgtgtacatgcgcttctcagaataatgtgtggcaagaaccctcactgggtatgccacacccatttgagcatatattgctttcaccttgggaaccgtggccatagtgacgtgtttgctgatgaaatctgtacacaactgaccacaagtagtacaggatttcctattcatatagctctaggtaaagtgtgagtagagatatagtctacttgataaacattgtatccacatttgaaatatttccttgtaagtatgtattggccaaaataaaatatatacagctgaaaaaccatcaggtggctaaatcgtgtctttgcagaagtctcaaagagaaagaatcagaggagggctatgtaattagtcagagctagaacttggtagcagttgattgacatctccctataggcttcagtgctgatgcttagaacaagactgcttctacttaggtttttcatccccagatctgtgtgtaagaaccagcatcatatggtccatacactatcgctggtcctaagtcctgtcatgcatcacatactggacgtttacggcacttctggcttagaaggctgctattcaatgcggctagtagttgagattttcacttgccaagggaaggtatttactgtgtatagtgaggcccaaggtctgatagaaaagatgggaagcaaacctgaaggtaaatttgcccaacacaagtcttcattgttgtttattttcaagcaaaagtctatttataagcgaggtctgttgtaatattttgacttttagttgtgacactcattctccccctcccccccccccaggcttacttttaatgatggttcttaaatgctttaacctcccttttagccctctacccaccagatatagtggaaagggatacgggggaagtacatctgtttagaaatggttctttggaacaagtcccttttgtgttgtctagcaatcagcagttcagtttacaggttaacagggcagcttgactcactcacaaacacttcacggatacaccagcagtatagtttggcaaagtcggtatagcaagcacgaatcagcagtggtggcactacctatcagagacagccaggcctccacctccacttgagtcagcaggagggaccaaggccaacaggaacaccagcaaaagttctcagcctctctcagcaaaacaaagatcagtgaagacaaaagaccaacaagcatttcacagctagctctataaggaagcctagctcagcctccgtcactgtcccttgagtcctatttataggctaggtgcggcagaaattgaggttccccagcagcaagtgtcttaaacaggggtggggttcatataggttttatcttagaaggcttgactttgggggaaaatgctaacctcatatacgtcctatgcaatcagtctcttttgaagtggcttgttttttcatattaactactcttattttcattatagtctcctaaaaaaaatggcttgcctccagagtttcaattgtttttgacaaattaccttcaagaatcaacttcaaaggagggtaaggtttatgttgggtcttggatctggtgctatagacgtgttgacacaatacatcatggcgacccagacacaaaggggtagaaccaagtcttaactagttgctattgtatctcttttccctttcagaggcatattgaatgacttgacttttagtacctgttaagggtttccctacttactggcagtgccacaggctggcagccaagcctttgacatggacatttaggggacactccagacccaaactatgaccgttacattctctaactgtagtgtttctctgaagtgaatgcatcactgtagattcaacttgataaagtaagacagtgtagctgtcttcagacacacaccagaagagtgcatcagatcccatatccagatggttgtgagccaccatgtggttgctgggaattgaactcaggacctctggtagagggggtcagtcagtgctcttaagtgctgagccatctgtccttcttgaggctgtcctaaacaacaaccacaaactcaaatcctgaaaacagctcagcgagggccagagaacccatcaagaatgcactaggaattatagaacaaagagagttagaaatccaaggtatttaaaaaatataccagtagaaaagttaggagagcagttaaagccagccgaagactctcaactacaacctcccagtccaacctgatagatagcattcaaagtctttccataggtggaggataggtttttattaggttaatacattccaaaagatttgatttgctactccagttcctaggtcaacaaagatgggcaaggtttggctccttagctgggcttgagatagcctgaaaataataattaattgtcgtgttgaatcagcagcgttgcaaactgaatggagtcactgaagtttttatcagtgttatcagcctgtgtacagaggtgctttccaggaatgttcctgtgcatcgagcagttcaaattctagtctttttttttaaagggtagtggggacctaaataggcatttgttggattgcaaactaactttgaacctaatccttgggttatctcacaaatacttctgtttttgttttttttttttaaattccaatttctaatccatttatagttggttaagcagcagtctgcctgccagtctttgctaggccttcctataatgcaagctttcagcggcagttattaatctcgtgggtgttgaatgataaacgctgctgctttcaatagacctcttggtttcctgctgggcatcagcagggagcatgcttcagtagccttgagatggggcagagttttggggtcagctggagaacacctgtgtggccctcatttgcagagcatggcatccacagaggccaggaaaagcttctaagagcgctgagttgtaatttgaagctatgtcagcaagtgactccaaagaatgacgagtttccaggtgtgaaaactacctacattaagtctgtgagagcggttatttcccctcccctcccccttctctactcacttttgtaacagatccttctaggctggaactcaggctggacatggctatactgtaaaggtactgtgacttactgtgaccaccatgtgggtaatttgaggagcagggttctaacagccgtcgtggttcacttttctgtacgtgtttggtgggcaattctatcctttgtccccacacacatatgcatctgcctttgacagacagtggccaacttctctctgcctctgacactctagccatggatgaaatcttagtctagtcctgcttcaagttggcctaaatgatctttgcactttctttcctttcctcgattgtaatttaagccctagtttcctgttattgacgaaacgatgctctgcgtatgttctctgtggatgatgggttagagggaccctccctcgcagagtcttgtcttttggttggagtagcaaaatttgctcatagtgattattcatccttaaaaggagctcacaggcaaacttcctagattgtcattacggaaatcagttcatgacctttgaaaggggagaaggcgttcagggttgaatttaaaagaaacttggagtgtacagtgtgtgtgtgtgtgtgtgtgtgtgtgtgtgtgtgtgtgtgtgtgtgtgtgtaagtaatgtaattgaactgtgctcaggttatgagcaagcaaatagtatttatgcaaggaaaaccaaggataggatagaaatagaatccgtctgtttttttaagagcttatacaagaatcccaccaaagaagaaaaaaataccaaatactacaccatacgagagagaattattcaggccagtgagaagcctgcttggatgtagaaaccagatggtcttcattagccagaaaccttaaaacgacataaatccactgatggggccaagcgatggatccatgccccgtcttgccaagctggcctttttaaccaggaaaacagagagctccttgttcaagcccctcttagctgggactggggtgaagaatgctgccaaacccgttctataaggaattctgatcttgataatgaaaaggagagaaagttcctggagagaaggagcgccctgtttgaaaggcagaaagagagcttgttccagacgctgcctcttcccttcattgtaaatggtaggggttggaggggtagacttccccattcaccctctgcagatgggtccaagtcaagtccatatgtttacctttattttagctctgctgatttaaggccaacatctagctgcagtaccatgaggaaagtccatggcatgtctttgctctctgtgttgtggctcaaggaaaaaaaaaaacaaacttttttgttttccctgatagcaaaggtttgtttccaaaaaggttagccgtgtttttaagagtaatatttccgtggctctagctcagcgtttttttaagtagcctctttgcttttgaagccatggctgaacacctactgtttcagctggctgttttgtttgttggcaccgaacactgttttcccatgggaaaaatatctccagtttcaggatggcggcagcaatccatacaggttattttcatacgcagcctccacaaaaccacacgaaccacgcagagccacctgtgtacagtatgggttctagcccgcactgttgacttacatttctgaaaaaaataacctggtggtgctaatcccactggtggagattaagaccactgaaagaattttttgatccaaatttgaagcaagcttttaattaaatactggccaggatgatgaactctggcggggtccattcttggggtcccaggaaacagtaaagagtaaccttctgcagaggtttgaaaaggccaccccaacaggccaccatgtttcccatcagggccatccagagcaagtgtaggtccagacgtacttcctgcttgtgtacctcctacctacatccatccaatctgggccaaaggtcctacatcctgagataattcctgtctgcatgcatctggtgcagttgagtcaagcaaacttgtttaagggagttgcttccagcctctctgcaaggatctgtccttgggcaagggacttacaggttagaggcattgttgtttaatggatctcttaggcacagtaattagaacatacctttggctctcacggcggttcagtggagtggttattccactgatcataattctccacttactaagcggcatctgttgcttttccaagtagggagatattttttagaagcgaggagtagatcttccagttgacattgagaggagaagaggaatctgacagcaaatatgttctaggatagaaagacttcaattatatgaacgttcatactgtcaggctctgagtagaacattgcatgggatttattaagctttttcttagagactttgttcaggaaaagaggtttgagtaaacctgttcggactggccgtgaggcaggaaaatcttacgttctgtgtggccccattgtctgatgctgctgctctcttcttggatggattctgaggctgggttgcttatagcaaccagcatgttgacagatgcaggtgaggatgctgagagttgtcttgtgctggttaacttaggcgggctacaggaaggattgaaaggcttctgattcactttgtgtgtttgatctaattgcttcttcaatatccagctgcagctgatttggaaaagaattttccattagagacatggttttttgttttttgcttttgtttttccttttaagtacacatttgtaaaaggtagcaaaatgttaaataaaaccaattctgctgttcctagttcagtaatctattataattttggagggactagagctgaagttcccaaactggctctactttatggaaatataatatgttgtttaaaaccttctctatctatgtattggctttcatacttaatatttgtatcagctgcttctcttgttgctgagacagaacatctggcaaaagcaatttaagtaaggcaagctggctctctctctgagggtagcatccatcatggtggggatgtcatggaagcaggaggatgaagagctggttgtgtcagatacatagtcaggaagaggagagagatgaatcctagcgaccaatttgttctctcctttttttactatgcctgtggtcccagcccatacgatgaacctgttggtattcagggagggtctttactcttcagttaaacctgggtggaacaacccacacagattgttcacaagttgaccacagacacaccccaggttcgtttccacggagattctaaatgcagccaagttgatgatgacgataaccactacaacattaactccccttgcacagaaaacccgaagggaacataggcatatattttctagtttaaactcactttgctgagctcacaacatcatcagaagactacagggccgtagtcagtttctttgaagagatatggaaaagatcaccaccttttgtcagcacatgtattctacaaacagatggcattaaaataattttaaaggtaagagggagggtggcatagagaagtatgaaagacagaaaaacgaagttcaggaatcacacttaggaaaataaagcataatttatttgataggtttaattaaaaaaaaaaaaggtcaggtagtatgacagttgtggaaaggacttgactggttttagctgctccacctgtacaatactaggcttgtcaccagtgtcatggatgtgaggagcctcctgtgctgacctattgttaaccattggattgcgtgaggtgcgaaagagaagatcatttattgtcatcggttgtgcatcagactatgggaccaatgggcttctacagctagttccaagcctgtagctatgcagatggcccgggatagcttaaaatcaatgaggaataaagcaaagcaaactgtcatgaatgtggggaaggggcttgtagagaggaggggaaaggacaggagtgggaggagcattacagagggtctctattgctgtgaaaagacactatcaccatagcaactcttagaaaggaagacattaaacaggagctggcttccaggttcagaggtttagtccactatcatcatggtcagaagtatggtggtacacaggcagacccggtgctggtaaaggacccaagagttctacatctggttcgtctgacagcaggaagagagagtgtgtcactgggcctggcttgagtatctgaaacctcaaagcctactcccagtgacacatttcctccaacaaggccgcatcttctaacagagacactcctggtgaccaagcgttcaagtgtatgcacctatggggaccattcttattcaagctgccacaggagatgaaagtaagcagtagacacttcatacacgtgtgaatgtgtcaaagaacaaatttagtccattaaaaaacaaatccaaggaacaaaaacctcaaattactcttctgatggttccattgaattccttgatccccacagtacaccaccagctagtgttgttctgacgtaattgtgtatgtgcagaaaagggaagggctctttaggcggaagggaacaacagctctgtcattaggatgtcctcagctgtgggtggaattggaggataggactcagaaagggggtgattagggaacaactgtgacatttcatggtgacagaagccaaaaggcagagactgctaaggaagaaggattcacatgttgcgaataaggccagtggggacacaggtactaagggcatcctctttggtttctcacattgcagtcatatggaacctttgagaggcagacaggtcagggtgagatgagtaaaccaggttacaggggccttaaggaacaagtgaatggaccggcgagatggctgagcagataaaggcgccaacaagcctgacaacctgagtttgattccctgggacccacatgatgggagaaatcgttttcgcctacaagttgttctttaacttcaacatattcgccagggcagttagttgtccaccacccccgccccacacacctcttatcctcacaacatacacaaaataaataaaaattttaaaaagcaagtggaaaatgttagcggccagtgtttaaaatcacaagatgatttaaagtttgtgaccagtggaaaaaaaatatgcggacggacagggtggagttggctatgtcggatttactgcctgctttgtacatacagttctggatgggggaaagccttcattccttcgaatgttgttaaaggccctttctcctatagcacgagccttaaatacgtactagccggtcctttcagggagctctctgacccctgactgtagaagcatgggcaaaagtgaggaagtgtttgttcctcgtttggtgtgttcagcagaagagctcagaggctgttgaagagcagagcaagagctgttagtgtttcttgctgtgtgacaggttgcctcaaacttactagcttaaaacgacaagtggttccatttcagcttctgtgagtgaggaacttaggagtccttctaggtgctctgcctctggatctctctcaaagccacattctttttttttttttttcctgtgttggtaactttttctttccatttttattaggtatttagctcatttacatttccaatgctataccaaaagtcccccatacccacccacccccactcccctacccacccactccccctttttggccctggcgttcccctgtactggggcatataaagtttgcatgtccaatgggcctctctttccagtgatggccgactaggccatcttttggtacatatgcagctagagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccggcatagtctcacaagaaacagctacatctgggtccttttgataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccacttctaaggaggggcatagtgtccacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaataaggctgctatgaacatagtggagcatgtgtccttcttaccagttgggacatcttctagatatatgcccaggagaggtattgcttcaaagccacattcttatggtcacccatggctgtagccagatgtcattggtgtcactgaggtgtggcttatgtctaaacttgctggtgtggctctgaacgaggtcggaccttcttattcttgggattcagacctggaacaaacagatgaggtgcatatttaaccaagtggacctgacctccagattctcccagaatccctcagtccgtgtttattacagggcatggctggcataccctgcctctgtgctgaactttccagcccaggggaggggcttgctctccccccagaaggaggtcttccctacacaatccagatattttggtcagtctctttccccctccatccttctttccctctctccctccctccatcccttcctccttttttccctccccactccccccccctctctccctccctctctgcatgcacagattctttctcttcccccccccccctcctctatctccctataaatggtgacatccctggcttcattccttggggccagtgaactcacccaagagctgccctgccaatacccatttttatactttaatttggcttgaactggctctttttgtcagcagagataacctatcacttaagattgcccaacaatgagtgagccgcaatgtcatgaccttacttttgaacttgcacatccccatttctgacaagcattgtctgctgcatagacagactaatgcattatgggaaaggactgcccaaggtcgtgatttccaggaagcagacaggatcgtggcgtctttcttgggctttgactatcccaggagagaacttgttacttaaattctctttgcagaaggaaacagtctctcctgcatttgcgttcagtgagaggtggtgagctcacctggcctgtgggagtgaagaggctgtgaggctcttactgagggaaatggtcctcaaggtgaggatgggattcttttgatgatagattcaccaacttccagtgaaagttctgtaactcctctttggttagggataagatggcaaggtgtgctaaccgtggaaatctttgggacagagtagggctcacaataaggtttgcagtgaccacaaacaagcccccccttagcctccacgccagggatttccccacaggtggctgactatgatttgactttctttaacttccctgccctgttacccacctgcttatttcagtaaaattggcaagatgtacattttgatctctaagatccgggctttgaatttccttcaaactctcgggtgagcggctaagatcaagttcacagaacattctgtttgggacacaactttgcctctggtggagaatgagacttccagtttcctggattggtgggagatgacaggggcctcctgtggaagagttgagcggccgcaacatcgaagggagttcttgtttgtttgtatgttttgttttatttcaaaatggttaattctccagtggaattttctaacgaaaactcagatacaagctggcctagtggcacacgcctgtaatcccagcactcaggaggcacaggcaagtgatctctgagtttgaagtcacgctggtctatacagtgaattccaggccaggcagggctacacagtggattctaggacagcttaaggctacatagagagatcctgtttcgaaataaaacaaaacataaaaactaacaaaaactcaatgcagccagtggctcagcattgaggcactctgatgacatcatgctgtcacctctagtctaggccttgtcatcaagcagggactggcattgtgctgtgtgtgagcagctgcgggatatgagaatgtgggttcttccacggggcttatatttatgttagaaacccctctttattgttagaactttccaacagatactgcaaaatcttctatggcaaaactaaagaattattgaatgagcaaatgtccttcaatactcttagtgccttcctttaaatactctgttaaagaacacgctgtcttccgtaggttattttctgagtctgtagcatgtatattagcccaacaatgctgatgccgggttgctgtgtgactgaagagcactaggcatcaccatcatattttctgttcttcgtggagctgtggattctgttactaactaggacttattctcttaggtacccactgatggcaacgccgggctgctggcagaaccccagatcgccatgttctgtggtaaactcaacatgcacatgaatgtgcagaatggaaagtgggagtcagacccgtcagggaccaaaacctgcattggcaccaaggagggcatcttgcagtactgccaagaggtaagtccctagtggtgcatcaccggcattcactaaaagtatttactttcttacatcttatatttatattttctctcataataaaaatcctggttcctaatgatccactatacctttcatacagtttttctttactctgcagttcacacagttacatactgctctgtgctatgaccatcaataaactgggtaaaatttaagttttcacagtttactatgttctactgtgcctgtgtaataaagggataaaggaattaaaagtgctagatttaattatttatttttgttcaacctctttgacatattttagtacaactacaacttgatatttttctagctttttttctcctgtaatattgtatctttgaagtaaacatttatgctgataactctagaaagtatacagaaggtcacttccacttcatcccatgctgatgaatatttttattctttaaaacgtacatttttatttcttgtatatggatgcttgttttgcctgggtacatgtctgtgtaccacgagtgaggctgatgcctaaggaggctccagaagaggttgtcacatctcttgggactggaattaccaaagtacagttgtgagctttcatatgggggcttggagggaggattgaagtttccttttctgaaatgcttgtgttcagagtattttggattttatagaatttgaagtattcgaaaggtcatgttgagctgctttgtggatgggacccaagtgaacatgaaattcttatctacttcctgtatccctcacactcacaactgtaaggtcattttctgtggtgcttttcgtttgagctccttttggactgcagcctgtcccatgagatcaggtaggaatttcccacatatagattcagagcagctttccaaaaagtgcctggttttggaacatttccaatgtcctgtgtttggaccagagatgctcagtttccgtcttctttgcctttctcactagccctttttgaaagtaagccacagttgtcaaggacttttcctgccgctctatgacatgggaaggaagctgtctcttcaggtagctacctgtctgtaccctaagtttcccatgattccaaagtgctagcagtgactgactattccagtagacttcagcagaggccagtaggaaggctggacacacgctttgtccgtgatggtgccttctgaatttctatgtgaatggttgttagtacctgtggatcatcccgtaagcccgtgttttccacaaatgaccacatgtttttaagcctatgaatattgatcctacaaagattattttccttgactgggaagagccctcacttcctgctgccctgagcccagtcatgcctgggtagcttcattttctgttttagtttgtggcttgtgcagggatgagccacagactggttctttccactccagactgcctgcttgcgggtagccatgggggaggagcaggggaaagccttttggcagatttcttctttctgccgctaatgtagcattcatctctccttgctcatcacctgcagtccattggacaagaaagggctaacatatcaagggtttgcgagccattttcatgaatttggtccgcatcctataacaatgaaaagccactgaagccattcgttggcttaatttttgaagaagaggagagactacgttggaatttcagagtcaaccctatccagtatatatcactgtagaacattccagacacctggtcccaagcccatgtgacggagtttccagtccctatgctttttgtacagcttgagcacttgaaatgtggccagttagatctgtactgttgagataaatgtcatgtttcagaaatgtaataccaacaaaggcatacaacatagatttcattttgaagtgactatattgtgtgtagttattaaggatgtcataaggatgttacagtcaaactatatggggttaaagttgatttcacctctttgtggtttttttttgttttgtttttttcatgaagctggaaaaaaacttgaatgtccactggccacttgtttgtatttccactcagcagtgctctcggcttgtccagtgtcactgtgacagggtcgtaatcaattcattatccggtcatctgaagcataagagagaaatgagctggggagtccccacagattgccactcagaaggttcttggaagcctttaaatcacattgttcaatctgggtgtggtggctctctcctgtaatccttacactggcaaatctgagccttagctatagaatgaaatgtctcaaaagcacaaatgagggagatagagagatggcagagggagatagagagatggcaaagcagcttagagcacttgtccgtctctcaaaacatgctggtctgattcccagtcccacttggtggctcagaaccaaggatagataactctagttcctgatgtttgcataccctcttgtggattgcatgggcagcaggcacccatgtgggtgcacatacatacacatgcatacatgtgggaaaaacacagatgatataaaaataaataaatataaattagtatctttaaaagaaagaaaatcatcttactagaatgtttcaaggtgtggagaagatataagagccagtgtcttcctctttgagacatttgcctctggatggtaagatctccgtgtagacccactaattaacataagaggagcacagctccagacccaaggtcttagtgctgtaaattgacagggcagaggtgatgatgtcaccacttgtaatcccttttcattcttaacaaagcctcagcctcagggccaagtgcttctgtccctttaacccacttagtgacacttctggaaaggagccttggaatagaccttggggaaatgcaacatttaaggggaacaaagagatgctatgaagtggccagagacaggaccagaactggcatgtgtcatgtgctgggagacaagctaagttaattgctaaacagagaaaaatgatgagacaagtatggtcaaaaatgagagcgactgaagtgtgatttttagcaaggtcagcgtgtgcctccatgaaaactgaccacatgccaaaagcaggtcttcagtgcacttcttaaggggagaagagtgtaagcttttcagactggcccaggttgacttggataggggtagattcttagcacgtttcaattgcatggatgtgaacagggatcaccagcaattatttccataggctaggaagcattgacattgctcacagggtctgtgcccataagcctataaaatcaccactcaactctaaaacagtatccctcaaatcaaatcatctttctccgactagctttgggtactggacagccacatctatctgccttttactggctggatactgccttttattaggcagaaaggttgtcttttcttctttcttcctttctttctttctttctttctttctttctttctttctttctttctttctttcctttcttccttccttccttccttccttctcttcctttttgtttgagaaaattaattttgacaaaggacattacccttaatagagacaagcctaattgctacaaatatgacatgaccaagtggcgaggataattatcactctgaggaaaaaaaaatctagataaagagcttgaggtgaacagaggcaaaggaaaccatcttcgctttagtatttatttattttttgtttgtttgtttggttggttggttgattggtttttaatgatggcaacttaagccaaaggagactgaagccaaatcaagggaagcatagttgtccatcataaatctcaggtgtgtgcagaggaggaggctagatattgcattggacacagctatgctgtccagtacctgggaggctaaggcaaaaggattaaaagtcagaggccatacttggctacactgtgagattctgtgtccaaagagagagtagggtgagccgaaagatctgaaggtgaaaggagactccgctgaatctggtgagttttggaaatggcaaagaatgacctttttccaagaaacggttaactaggtaggttctgttgcccagagacaaaaccaatggaacagcccatgtgtgtggaagagggtttctcctacatagagaaaaaccctgggctgaaggcagctttcaaagggaggaagcaggactaggtcctgtgttggagtgttggagcagagaactattcccaagtgctacttctcctgttaatgccgttctttgttctgcctttactcctcttctggtgctaagatgggtgccccttggggctcaggaaggtcggaagctggcagccagtgcttctgggagtggcatcccaactttgtttgccattgtgtattgtaattccagggagaagggattctgagtggcttcgtgttgaccacacaaagatttggcgcctgcaccagggtacttacccatgtggctgtgtggtctggcaacccacaaggcatggaagaatggctgctcacagaagagggagagaaatgcacaaggccaaaacggaatgactgtggccctgtgtacagtggcgacagagctgggtagttcttttggctgaaagtgctggctgggatccacattgggtcttgactttaactggcacagagaaaatggcagagtggctggagatgaccacttggggccgttaaatgtagtttgacattgcctacaagatctttcattagtgttttagtgtttagtgtttagtgtttccctgccacttcccacattgtagctactcctggtatttttaataaatagctctgatttatagatctgaattttttgtatattttgctagaatacatttctttgcttttattccttctttaactatgtttatatattaagtgacattgattgactcattgcatgaaatgaaaaggaaaataatactcaacaatttttgctaaattataatatttttatatttttaaggttgaatattaaggtatgttctgttgcaggaattcccatgtcagatatttcttttcaacaggacttgtttagagctaatgcttccagccatgttctaatttctgtattacttattaggctgttatactgttattattattttgatgacttttgccttaattagtcatttgcaataattttgcttagtaccataaaggtgatctcctttttgccatctctcattgcacagattcctttgaagaattctttgcaaccctgagaccagagttctacccccagaactcattgtagaaaaagctacatgtgaagtacaattataaccctagtgttggggagccagagacagacaactggtcaacctatcttacttagcgcattctaggagaatgagaaacccttttcaagggggaaaaaaatcaaaagatgaatggcatgtgatgaatgacacccaaagttgtcctttggccaccgcacacatgagcacacacacacacacaccagaaatgatctctacttattaccagtaacaggactaaacagttaatggttttttgtctccctgtaatggtgactttattttatgcatggactctaacctcccaagactgagacacagatgttttagaagcaatctgctgagtcagagaggcagctgttagcagtctgagcctagggcagacaggaggagctgaactcatgactataacctcattttgaccttttgctaaccaactgaattttcctgctaaatatatctgtaatagatgcctttaactgtttgctggtgcttagcccagggtggtatcttaatattgatccttttatggggaattaggtattaactagtttatgtcctctgatctctctcactcttcttggcttatcttccctgctattgacttgatttggaagtctataagagtggcatttatgtccctttggttcctttggagctatccttggtcaagggaaagaccgaggagaaacagtaatggctgaatattttacctctactcctaggtacacataaggccttatgaagtttgattgagaaaatagttttgattgtatgacctaatgtgtatgtttgttttagccacatgttgaccaggtcttccaaatgtttgatgtctatatatttccttctgtccccagtcatagtagtttttcttctacccagtcattgttgaagtacatgtctctctcttttatttctatgctttttattagctccatgtacagtttttcttcagctccttatcaagcacatattgagtgctgttaaccaactgaacaattctgcattcccaaagttcataggttaggctaactctctttagataggttttggagacacagtctttcagagatgactagtattgatgacgtcatgagggcagagccctccagatggtattgatgcccttacagaaactgcagagagccagctctctttacttcctcatacaaaggggtcatgtgaggatgcagtgtgaaaatagaaaaatgtcctcagcagcacattcggacttggttttgtcactttcctgaactgtgacaaaatagatttccattgttagagttgcccagggtgtggtattttactgtagcatgtccaccaggaccccattatgtctcctgtaggtaaaggctctagaaacccatggtgctacagagagtgacatttttagggtcatgattcacaaagcattttatctgacaactgaagcatgctggtggccatttggtaatgctggtggatgactttgttagcatgagactgtagtaggatgggcagaggcatccttgtctatcctgagggagagttccctgcaggagcacctgtggtttctgcctgaggggccattctgttctactgttcctggttttaaagttgttagacaagagtcatgggattgcacagatttggcctcattttatatacccaacaaaaagtgcaatgagaggacctgcaaccttagagagaaacacagagtgtagctttaaaatgctttaatattgtctgtgactctttgatggaggaaaatagccttttctatgatcaatactagaagcagagtgctaacatggagaaagatacttaaatgtaacttcataaatttaacaatataacaatagccatttgtgctaatgagctgttggggtaccatggcaaatgttatggctgaagaaatgtcaaaatagaaaaagcctcagagaaacaaatattatgtattttctatttgtggttcctatgcattgtatagattcataaaatcatgtctgtctatatgacatgatggtatcaatgagatgtctaagggaacaagaggtgacagtgggtggtatagggtagggtaaggtagggaaagctatggaggagaatatattcattgtactgtttaaacttatgtgagagctctttatgcatctgagtgccatgtacaatggatggacacactcaaagctgtagaaatattaaaaataagagatcaaaaaccattaaaatttagggtcagaaaatgagacttattaggtttcattgcatggctttcaggtgaaatgatatttttttaaaaaaaaaatatattgtttcatgtacaccaaaggcttcagggtgtgtttagttccacgtctcaagactttatttctttacttttaagccaggcaaccctggccagcgtagctaaagactaccgaggatagggctttgtgtcagacaatgcctttcctggcttacaaggggtgcaaacatgctctgttccatcagattgagaataaaacctagaaaatggagacagtggtaggtagcaaggagggtcttgatggtgatgtggagactctggatccaggttttgagagatggaagccaggggatgtgttagtatgagtgcttttagtgagacatttcagtagtgtgtttcaaaggttgggctgactggggagagaatttattttacaaacagaggtgggaaaatggatgtgaaagatcatcctctgaattctgtcagtgaccccatggtccagtgtatgaagtaccatgattcagggcaatccacaaacaatgtctcagactgtgtccttcctgtgtaaccgggacaggcagatgttatgaaagccagttgttatgagaaatcatatacagccttgatcctcctctgtccccctctggtcttaagcacacaggaaggacttttgctaggcaaagcttcctgaaggaagggttggctctttgagcatccacttggagccagcctgtggaggctggctgaggatgggaaaagtttcaagtgtaggtagtcagatggacgcacttggctttttgcatttcctctactcttagattattcacacattcttaagtaagtcctttatattcatgacaatgtctgtgatttctttatccttgttcctctatttgagtgctttctttgggattaacaggccctcaaaacaaagtagtcctgtgcagaagcaaacaaacaaacaaaagctggctatatgaattgaaaacagctctttcttttccctaactttctattctaaaatttattatataacccaatgtgggattcccaggaagagttatttctctttctgttgtcattcttcattaataggaaacaaaattgttaaaaagacaaaaacagtttgtcctcatcaatctaactgtctttcagggttgccctgtgataaacagcatccccgaaataaacttggtttgtttcagttcacacgttacagtccatcactgagggaaactaaggtaggaggaacataaggcaggaatctagaagtaggaactgaagcagatctgggccatggaaaagtatgggttactggctggcttgctccaggctcctgttcagctacttttcttgtctagcccaggcccacctgcctagggatggtactgcccacagttccagggtccccctgtatcatttaacagtgaaaaaaatgcccatagacatgcctacaggccagtgtgttggaggcacctctttagtggaagttccttcttttccagttcctaggtttgttacaaatggatagcagatgctataggagtgtattctatatactgttgtttctctctggtcactttatgtgctcaaaattaacccacagatcataagcgtcatagtcctgatacttaaaaggtccaagaattcatattaagtaaagcagttttttgaatcggtggatcataatttttgaatatgagtactggtgtatattctgcatcgatggtctatttggattcaaggactacttggaacttagggctaaaagagatgaagtcagtctaaatattgtaacataagaattatagtgagggtgtgtgtcttagtaagccttctgctgctgtgataaaaccctgaccaaatccaactagggggaagaaagggcatatttgatattatactcccaggtcccactccatcactgaaggaagataggtagggcaggaacttcagtaggacctgaagcaaaaaccatgcagtatcgctgtttgccggcttgctttccctggctggtgctcagccaactttcttagacaacccaggacctctttcctacctggggttgcatcaaccacatcaatcaacattcaagatggttccccacagaccagtcagtcaggcaggcctgggcaatccctccagcgagcctccctcttctccagtgattcttggttgtgtcaagttagcaataagaactgacagagagaaaactgatgtctgaatgaggccatgtgtgtacgcatgtgtctttgttttcacatctgtgacgtgccttacacgctaggcatcccctctttgcttttctcatgagtgctttggaaaggcagcggcataccagccaaaccaggctcctccgtgccttcccgcaccaagtgtgaatgtgcggctagaacaacacattaatatgcagtgtcacatgcagaattgggccaaatggttgggaaacacactcttgccttgcagcgctttgccttctgcctcgtgcaaggcatccttgtgagagcagggcccactctgctcccctctctctgacattgcagacgtgtttcatcagctgcctgtgcctctcagcacctcattaagtcacgagcagccgccacttttcggcttccatttctctttctcaactgaattagatgttctgttttctatatcccctctcattagcagaatcgaggcggaaaacagttttaagatgcagttttttcatcaggttctagaaactttaaagtgtgtcacttaaatctggaaacagaaatgtattctcttccgcacaccccagtcttggcttacacacaccaaagtttaagcagcgaagcgcgtgctgttaatgtggtctccgtgtgcttagaaaaggcacctgcgatagttgtcaatccgctgtgacatgctgcccaggagatgtttgcagtgatgtctgccattggggaaacctttattatgatctggttttattttcttcttgagcattctcttcgtatggttcaacctcatggaccacatcagttctggacgccatagtttgctatgcctacctgtgagctaaatgtcttgaaggaagcatcacaggttacatatggggttctggtgtacagacttaacagttcctgacattaaaaaatgatagagaaacatcctttaagatagtactgcatcctttaagatattttattttaagaataaaaaccctgactaccgatatcatctttttgggttgttttggttgattttttttttttttttgagataggtttcccctgtgtagctctgactgttccagaactcactctgtagaccaggctggccttgaactcgggtatccacctgcctctgtctcctgagtgctgagattaaagctgtgtgataccaccttgctgctaccactttttatagggaacccaagatggtttctacatgaccatttttctggcttttggtattttggaattttttcaattctctatttaaaaataattttatagactgatacttaatcctttaatgatatggcatgattctaggaccaggtaaatgggcctttaaaaaaaattgtggatttaattcttccaacagttcatcttcagctgtgtattattgttagcttatttcaacccaagatactattagaagtataacctaccacctctgtttagaagaacaacattgagagaattatttttctcaaaaagcataaaaccaagtagctgtcttatagtcattgggcctagcagataggtgtgtgatgcccagcaagagtgtaagacatgtaaaccatttccatattgaattgtatcaggacttaaccagaaataacattaaatatttgtcagacattactgtgctggcatagtgggaggggtggtgggtggggactccaactgcaccgcatggctcttgccttcaagaaggacatgttccagcaggtgtctaggaggtaggacacggtcagttgccaggtgttgtcagtgataatagccatggcatgaagtggccttgttccagaaaaagaaggattcgtggaggggcatttgtgaaaccagcaaataaaggggtccatttctactcagctgaaaggaacatagcactaggttttaatgtatctgagggagatatactgtaaaggggtgtttcctagaagctgagtgcccttgttttgagtttcggaggctcggtgctcttctgcagcttctctctctgcacctcttcctatttacctcccctggattgccctggctcctgctgggcaccgtacacctatccaccaagcccaatactatagccagctacttgcttttatgctttttgaaaaaaagcattgtcatcctgatgactggcttccccgcctttgctctggcttccccgcctttgctctggcttccccgaatacccagaactggaaccacaggtgttttccagctaccatgttgatactaggaaaggaacctgggtctcctgtaagatgcaagtgctcttaactgctgagatatctttatctgcacccatcaagtccatgattttcatcaagaaagcaaccgtacacacaaaacgtagcaaagaaaggaccacaaacaaggattttttatgtctgttatactagcgttctggtacatacatcattagtgacagttgtcccactaacagcatattttcgaatgtaaagtacttgcaaattacatgtaatttgtaatgcatgtgagaattgaggactaatgtccaaagtttttctttaacttctaacaacttcctgctgtttaggatggcaaaatattattctttttggcgattccagattaataatccttcatctctgagtaaaagtgactgagtcaggttgaagttgctgcatccatgtcacagatcagggaaatcagacaaactgcatgtgacatgactgacatatgccagcagtcacatacaggactgcacctgtacacattatatatatatatatatatatatatatatatatatatacttaaacacacacatacacaaaactcatggcatctttgcttcctttattaaaatttactgtgtcacaaaaatattaaatgttgtcctgtttcttgtgattaaatatgatgaataattaaatattgttacaaggttatttacacattataattcacttaatttttgttttgttttgcttttttgagacaagtctttctatgtattcctggtagtcctaaaaccaggctagcctcaaactcatagacatcctcttgcctctgccctcaagtgctgagatgtaagatgtgtgccaccacacccagataattcagtttttattcttgactaagacagtgcattatgtgatctaatctatcaacaaaaaatgcaccattgtctctatagacttcttctggagctacttaaacaagcattcataaatttttttttgtaatttttaaaaatataggtgtttcgttgtgtatgtttgtctggcattgctttgttggggtttgtacctgtgcaaagtcatcacattacctagctggccattcagtacttcaaaaggaaatttactactttaattttttttaaatcatctttttcccctttaaataaacttcctgctatttagaatggcaaaatattattctctttggcgatcccaaattaataatccttcatctctgagtaaaagtgactgagtcagattgaagttgctgcatccatgtcacggatcagggaaattagacaaactgcatgggctttatgcagttcgggttttataatctctcatctttctgcatatgaacactgctgtcagagcatggagggaggtggagaagcccagggagtcacatgtgtgtcctagattctctggatagaattggaaattaattgtctggctgatcgccattcaaagctctggtaatctcaagggagagccacatgttcacaggtttggtctgtcagcttgccatcttctctgcacagacactgggcaccgaaagatttactggtccgctgcaccagatattatcctaggagtctgatggtggtgtgtgagcaatgggagcaaggaggccccttctcctgctggtccatttgtaaactcaattccttggttgtaatggaaaggaaggaaatgtggtgtgactgtattagaggaatttatagaaaaatgacgtctaagatgcgtctcgtaggggcagcatttctaaagtgccagctgggttccctttagaaagatgcagtaactcacacttcactgcacataaagtcctatcccccagggcaaactctcatgccatcgagtttatgactcacaagtgctgtttgtttgtggtctaataaacaagaaaaggtgggagaattatatttctgtacacaacgctacctgccctccattatagagaataatgctatggggctcttaaatttttagtggcattttcaaggggagcattgcccgggccttaaatgcatgtactcacgggttggagatacttaagcacaaaaccaaatggagcgaaggtagctgtgccctttgcagctaaactgctggtcgtgtttgaagaacagggctctgccttacagacgaaactaattattacattttgatgttctcttgtttgtgcacgcatgtgagtgcgtctgggtgcacaggtgccaacaggtgattgctgaagattgaactcaggccagccggtgccttcatcagctgagccatctcactgtccccgacttgggtacttacgtatttgtttagccacatgattcctctgattgataccttgtgttttattatttgagaatatagttcctttttttctttgaaagagaagtcatacatttaccaaaaagcataaaagacggcagagagatgcagtagatttctcttatcatgaagatattctaccagaatgagccagccctgacaaggcatgaacccacactgtcatgctttgtcgctcacagtctatagttggtcttagggcttgctcttggtgttgtagctcctatgggtcagataggcgtgtgtgtgtgtgtgtgtgtgtgtgtgtgtgtgtgtacagggttatacctacagggatatgggcaagcatggacaccaactttgagtgtctattcttcaagagccatctcctttttactttttgtaagatttatcttattttgtctgtgagaatgttttgcctgtatagatatgcaccatgtgtggtgtcttttatatacaccgtgtgtgtgtgtccggtgcccacagaggtcccaagggctgctagatggcatgacactgatgttaagaatgctaaccacaatgagggcgcttgtaatcacaaacaattcctctgcaagaacaataactgctttttgttagcctgagttgtccttccaggcttatcaccttgttttatgagacagggtctcttaggcaaggccaactgctcaacgagtctcagggatctggctgtctccatcttcccagctctgtaattacacatgagcccccaacatgcacagttacaggggattcatctctggctcataggcgagtgctttgtccagacactgatcgttttgctgcctgtgtagagaattgtctttatagactgtcatgtctttataggaagtcataacagtatggatcctttatacactgatttctgccacttaatggtaggcatttatttcagttccctctgtgtattttcttagctagatggatcattttggggggagaggatactaaatatttctgtgtccacaatgtaattatgtagtttttaaatatccattttcatcgtcctgtctttcttcctttcctttcctttcctttcctttcctttcctttcctcccctcccctcccctcccgtcccctcccctcccctcccgtcccctcccctcccctcccctctcctctcctctccttatctttcctttcctttcctttcctttcctttcctttcctttcctttcctttcccttcccttcccttcccttcccttccctttcctttcctttcctttcctctttcctttccttttctttccccttccttcctcccttcctcccttcctcccttcctcccttcctcccttcctcccttcctcccttcctcccttcttttacaaacatcttttacctcacaaagtaaggtgaggtaatcaaggcataagtaatatcgttttatagtatttcaattagatgcccccctccccccataactgcaatggacaagatgtcagcatcttaaatgaagacagggtcactctgacaatcacaaacaaagtaccgcggcgtatccacggctcccaggtgggcacggtgctctagttcaggttcctaggttttctcagcagtgtgcgcagaagctggggatgagtctgttccgcatctccagctccacacccctccccctccccccaaaacccttaaacctgtctatgaactctagtgctttcagcctagactgtctttgttgtctatggatggagttgaccctgagccctactagcctgtggtacgcaccttcaatctttgaagtcttctgcttctggcttcctgtcatccattacaacccttttgtaggctgtagttatctgggaggagtcagtgatacctctggtacttccgtttctcaaacccacatcatgaatccttcagggacattggcttctttttgttttgttttaattatctactccctttgatggccatatttatattccttgcgattaccaataattgggactttctcagattcctaattttaattcccaaactctcccaagcactagtccttcctggctcactttctataatatgtctacaccaaaccctttagcccattccagaattcgaatcctgttgtcttacaaccttttgactgtgtccaattcccttcatgttctcaccttcacctcctggattcatcacctccagttaaactatctgcttccttacagcctttagtaaactatttccctggttatttatctcgcaaaatggctcactttagagccatattgtgtattgctattcttctttcaaatctctaacccattattattattacatagaagtggtttgatatttcacaaatacattttggttgattgagtttgacatttcgttccaagtgatcagcaaacagcatgattcatgagcagcagtcatcacagacagagataagtagtttattactgaaggaggagaattcctgagtgccgtcctttaaatggctctcttgaagatgcacttaataaaatatttttgtgtaaactgttttgaggacagaggctgatttttttgtgtgtgtggaaaccatctatgtgccatgctctgtgcatgaagtatttttcagatagcagtgagttgaatataagtagagatgacaaccttaagtatatcagtcccagggtttctttagaatactacaagctgtggtcttccctagcggtttattttgcatagaaaatgacctcatgctttcaagagtctgtgctttcccatggttctagtttaactctcctggacagtgtctgaaaagacagctcgatgcaagtcaccttggagtggaatactaggtacagccgctcaggcattttcctttgtatcagtgtccgtgcttggccagaagcagagcaacttggctcttagagaataacggaacctttgaataacagcgaaggttcaacatgtactctgtgtgccagccaggctttgccaagagtaatcatttcctcttctcctgtgttccccaggtctaccctgaactgcagatcacaaacgtggtggaagccaaccagccagtgaccatccagaactggtgcaagcggggccgcaagcagtgcaagacacacacccacatcgtgattccttaccgttgcctaggtgagccggttagccagccacccccacagctcgagctgaggggaggatgttgtaattaggtcatattcatgcatgcacattttatcagcatgtcactgccaacatattgttggtgccatacctttgagtttcatatctgcagattcatccaaagatgggtgggaaaaaaaaaatggaagtgcaaactccaaacagtcctgtgtctgtccttatgtttcatttaaattgcattagatattggaagtaaggagaggcgatgtatttgtttcttcattatttagtgtggtgattgagaacaaacataggactttataaaggttaggtgagcattctattaataatgtgtatcccaagcctgggggaggtgagttaaagtttgtaagcacttgtatgtaggctgtaggagaatactcattttctatgaggcttgaggttttagtgtccacaatgcatgaaagggcctccctccctccccacaaataccatgggagtgtatactactatagtttggatggtgcaggtactgccctgtgttcttttaatacaagaccagcattccttagctctctgcttctgaatagctttcctgtctcccagccagtccctggtcttctgagtggaaagtgtctgctggtgaaaccccagagacttgcaagggattctcgtttacactgtccagtgttacaaatggcaggccttgtatatttcctcacaggatttcacaggaagactataatgtgaggtctccacactctagctaattcctcagaaagcccttccctagggcaccccttgttcctacagttgaaaatgatcaggaagtatgtttgctggattgtttgattttatatttattcagatcgaaccgaaggaaaccatgtgttcacaaaggcctgaaaactctactttcatttttatcttaaaaaatggagtcctttttgtcttttgagaaagccatcttaagtccattttcaatcttgtcacaccttcttcctggcatttcatgtgaacaagcctgccatagctagccctgtttgatgtgataaatcccacttgaatgtttccattgttattgattaataagaaggttgtaagaatggagatctttatatggatagtgatgactttgaataaagtctaaaagaaatcttttttagagagtcaccgttccccttccaggtacaaggaggtgagtttgcattccaacactttagctacaagggctccaatcaaaaccttgtaaataaagataaatactgaagactctaggaacttgtatagttttgtttagctgtggattccatagagcatactggaagctggtggaacagctctgcagttaagagttcttgctgctcttctgaagaacctgaattcagttcctggtactcaggttggatgacacacaattgcttgtagctagctctagctccaggagatctgacaccctcttctagacttcaagggcacttgcgctcaaatgcacctcccactcctatttttatatattctttcaaggacatgctgacgtctgcttatttgcgcatgtaatttgagacatcaacagaaaacatgggccattagaatgaagatctcacctgtgtttcatattcagtaagttaacaatgaagacaatgttgaaccagatgcttgaccatttgatagtctgtgtattctcttacactcccttattcctttaatcccttattagctctttaagtatggttgagaagtcaagatttcataagagaataataagagccagattttacactgtgggcacataggaactatcaaaatcttagttttcattatgataaacctcattatatcattcagggacagcctcactaatttgccttttagtcctagtttatgtagcaaacaccaattagtgacctgccccctgcttttccctcaactgttagagaacgatttttcactggttgaggtttgtagagatgtccatacaggtcagacaggggtaagagaaagtggagaggtgcctcaaaattgtccaagagatcctgtgaggaaatgaggaagaccgaattccctgctgcctctgtcttcggcaaggaccagatttctcttttatcttctaaatagattctgagctcctttgatgttgaagtacataattcaaggaggcaggccacttgtgacatgtttagaaaatttcccgggtctggggcagcatctgatctaaatcagcacactgactctaactgttcctgactgctaatagactagatgatcattagatactcccagcaggcatttggcctgtttgaatcttttattgtgtttctcctataaagtccctggtcttttcccattggatctgaaacaaagggtcagttgacaggcagagcatacctgtctcttgctttgccaaagagcttagattagaattaagcaatgtgaacattgtcaatttcttaggcagtggcaaaatttctacgtgtctcagatatgttacacaaggcatataaaatgcgctgatgtgtatgtgtggtgtatcttcagttttgagaaaaaggaattacagaacacatataactcatgtctattgtttgcatgaacattgtaagttgcacctcttcacctactgtcttcattccttccctccctcttcccctggcttcctgatctgtccttcatcttgatgtcctgtcattggtggcatgggtcatccattggaatggctatcccataaggttgactctgttggcctcccttcgggagtataagtgttcattgctagagaagttggatttcttgatataagtcacacagccatgatgtgttcagatcaggaccagagcccacaatttcttgatttcttattatctgtattctttataatttttttaaaagaattaggcctggcagtggtggtgtgtacctttaataccaggacacagaagcatgtggatctcttgagttcaaggccagcctggtctagagagtgagttctaggatagccaaggctacacagagaaaccttgtctcaatgcctgccacatagaaaaaaaaagtattaaaacaactgtccacttggtttgttaattcaaatcatgcaagaaaggttgtgaatttgagacaataaatattaaaatccacagtagatatcatgttgataaaggtggcaatttggacctttggtaaggaatgattgggagttcaaattttttctgataattacagaggtagtcagtgacttccttctctataatttgcttctgaaacaaagaattcttgtttagcactaatctacaaactctctgagacttcccgctgtatccaaatatatattttagacaaaggagagttttactggagttaattcccacaaagacgtgacctaaaaacaagagtaagattgtcttagacattgccatattgaaattcaaaacaaatctggagagagacgcctgccattcctggcttgtgacctcctgaccgctgcctgtctcagatgaaggaccagaatggcatgagctgaattccctctataggggtgtttgcctcgggctcttagctctgcactatctctctttgctggtgagatggggaagtgtatcatgttacctttggcaccgttctcccatggaatggacggcttccgtcccttgggaaggaaggctagctctcctttccctttttatttttcatacttccagaagcagagtataggatctgacttgatcaagtaaacatcttatcatgtgccatatgtgtaatccaaagcacatcgttcatcgtccctcagggaagcggtcggtttttgtttttgctttttcgaaccttttccatttcagtgacttctctctttatgggataatggatgcactattgaagttggcacacttctgcacttgtgtctgactagtagtgccacagtatgttgcctaagataaatcactgttgcttttacagggccaaagtgcagttagtagtgtaatccaaaagaggaattagaagttgaggaactacgaggcgacactgcggtatgcccctgttgctaaggaagataccccaaatttgcaggttgtaatggccttgtgcagaatgagaaattaaggttccattctctgcattttgaattttataggtttaataacattataagacaagtctgccttagttcctagatggctgcttctctgaagcatctatagccatcttggtcttctttaggtcaaatagtgtgtatttgtttacttgatagataactgtacaacagatgtgtcaacttatgctcaacagatttttgttgttgttgttgttattgtttgtttttttaaacatattagccaatggtaaaatgtttaagagtaaaaatgttaccaaagtgtgaaagtaggaaagaggatggaaaaacatttgttttagactttaaatatcctttaaatgtccagaaacctaaatgttggactccagagaatttatagatttaacattttttttcagttttaatatgataaattagaaattaggtaccgtttttcctgataatgaatctacaaagtactcattaaaaccactttagttgttttaaaggtaagaattttatcaagattactgaaattgaattaatgaagatattatacttgactgataaaatactgctggccagggtaggagatgataggcttttaaaatcattatctaaaaaataacctcaagaatataagaattaacatgacataacagtgaatctaaagttcaagttaaaagacagtttagtatcaatatcagctatggcccagcatggtggcccaggcctttaacaccaatactcagtaggcagtggcaggaagagctctgtgaaatataggccaacctggtctacataatgaagtcgaggatagccagggttgcaaagtgagaccctttctcaaacaaagaatcaggaaggaaggaaggaaggagggagggagggagggagggagggagggagggagggagggaggggggagggagggagggagggagggagggagggagggagggagggagggagggaggaaggaaggaaggaaggaaggaaggaaggaaggaaggaaggaaggaaggaaggaaggaaggaaggaagattggttggtttaaacataggtacgtgcagaaggctctcattatttttctctacaatggagagaaattcaggtctttttttttttaaggtcatggtagttgccaagtagctgattaaacattctgtttttttacataccccttgatgaatttcatatccccaatgatgtgtcccaggggccccttctctgtccctcttcctagttctcttttcctgtgagtcttcagctttggctttgatccctaacagagaaggaaagtcccaacgcagcagctgggcagcagcagtctggagagcaacgagggaagattgcagaagagtggagggcatcccagaagtggggctcttgaggaagagatgacactgatggatgacctgctgtagagtcccagcttggccccttgtgtggctttagagtcctctcacagagtttgggaaaggtatagtgccgaggaaacataggaagtgaagcaaattttaaagtgtgggctcttactacttttggcaaacgaaacacagaacataaaaataaataaataaataaataaataaataaataaataaataaataaatacagcaaaaagttattttattaaaacacacagacatcagtgtgaacagctatgtcatctgtgttgttggtaggctttctgtggagctccgaggacaaggctcttagtttagcgcgtgcagagttggttggcccaattgttttgtgcctatggtgaggtaaggtggtgataggaatacatggattacctcatggccagcaataaaaagtaatgggagaggaggaagctaggggcttctcacacctctcttggagggcaaggccaccaatcacataacctcctctcacctccaggctccatctctcaagcattctgttaccccttttagtacctgtctcattggagagacgttgaagatgtgatcttcactgcctgtcttgaggaaggtaccacatgaggctacgctggtaacgttggtgtgaagagaaggcaggagacttaagaggtggtatcacctcccgctttggggagacttaaagtggagaaatcactaaagcaggtccttacccaagtcaccagcactaacctgtccccgtggacccccatagatccctttcactggggttgcttgtgcgagtatggatcagggcttgatgacgggagtcttaccagtggctacatcattaaagaaaatgtctcatctccccgtttgaatggcagtcaactgtgagagcatcgtgtcaggaaagtattacatcagtgaattggcgaatctgcttagggaaaagaataattgcagggctatattaggaataaatacttcatggggcagaagattaacaatgcttcctcgccatgcttttgcattcggagataattggtttctgtgtgaaatataagctctttggtgattaggacttttgttcgctcactgaaaactcccgagagcttagaacatgtcacagccccttagttcccgcttgtcaccatgtattgaaagaatgaactgaaggtttaaacgaatgggagggacagggagaaggagggacatcacttgaaaggcagaagacagggagtggaacttctcctgccaaacacttcctaaggtgacagcaggcatcagtgtccttatgtcagcctatgctgatagcagcatgactacagtcagccttccaagaagctcccttggagtttaccagttgagtgatttgagctgttttcatcaaccgccatggctcttatagtaagattgtagtcagaattcgaagttgagtttaaaatgtatgggtaccaaatgcatccttgtattttttgaaaaagaaaaaaagaatctattgtttggggctggagagattatagctcagtagctaagagctgttcttccagaggagctgggttcaggtcccagtacccttttggcagcttactgctgtctgtaactccagatgtaaggtatctgtctgacaccctctttgggcctctgggcattcctgcacgcatgtgcttcactggtacacatacacacactcaggcacagagagagagagagagagacagagagagagagagacagagagagagacagagacagagacagagacagagaggcagagacagagaggcagagacagagagacagagacacagacatacgcacatagatagatagatagatagatagatagatagatagatactatatatatatatacatataaacaaataaatgttttttgaactgtaagagaaaaaatattactgtgtgcgcgcgtgcgtgcgtgcgtgcgtgcgtgtgtgtgtgtgtgtgtgtgtgtgtgtgcgcgtgtgtgttgtgtcatggtacaactgtggaggtcagagaacaactttctggagtcagttctccccttttgtttattacctaggtttcttggtgagaatcgagtcgccaggcttgcatggcaaacactttaagctcacgagctaggccttgagcaggccttgcaggcctgcgtgcatatattttcctcgagatgttctttagtcttctgtctcccttttgacttgatgaagacctttgccccacggcccgtttgatttccgttatcactactgtgtaggcttctcgggctttctttgttcttcagagaactcttggcttcgtgtcagtgtgctgatcgcatgcatttcttgagcagacatctttgctgtctgtccttcacagttctgcctcctgatctggtggttagaggtcataggagggcctgttagccttcgactcttttgcagtcaggcagcatcaggagtccatgtctccagctccgtttatctgtggaatcactgatgctctgagcacagattctcttgattgtagtctttgccttgctgttccttctgtgcattccttcattgttttccatcacaggctctttttgtagacttcagaaatcctaactactggtgtttttctacagcctttctccctggtcgttcattttgtataactcacatgcttgccagaaaattccatccatgctgtggtttccctaatagccgtcctgagttatcatgcccaaggcaaggtttcttctctaggaagagtctcagatttggtgtgacctctggagtactggcacatagctttcttggacatttcaggagataccggtagatgccagttccttatgaagaaatgctgggcagtggtcgagcatttgcctgccgtgagtgaggtcctgggttcgagctccagcactgccaaatgaaacactactaatagatgataaatttgagatttttagattaaaccgtgcttaaacagtatgctatttttatcacttaatttattgctaaataccatttgcaatgattacaatttgtcataagagaggagtatagttattctcagccttctgaaaactatgcagataggtatatctgtgcacatgcatgaatgtatatgtgtgtgtgcatgtgtgtggtacatactcacgagagagagagagaaggggtagttatgagagattgagaagggctggagaaagcaagaagggagggtgtttgtgcatgtacaccccctacgcctgttcctttcttttatcaaagtctccaggactcttggttccttgcttaagaactaattaagtccatgtgaactaggagtcctgctgccaatacctggcaagcattcatggcctgatttttaatatattttaaagtggtactgtgtaattaacacattcttaaattttgacttctaaaaagcattttggaatacttcggtataaatataagattggttgcaaagtattggttaaaaatatagatgtggtctctagtttagaatgatgttattttatgaggagaatttaggactgtcctaaagctagggaccaaggatatggctcagtggatagagatgtttgtgcataggatgggaaagctgagttcagggcccacatcttggagagaaatgacctttgagagttgtcctttgacctctacatatacttgcttgaattctctctctctctctctctctctctctctctctctctctctctctctctctctcacacacacacacacacacacacacacagagagagagagagagagagagagagagagagagagagagagagagagagagagagaaatttaaaattagagctgaaaagacgaaagttaaatcatctgcaagcaaatgcagaggccgcttgctgagggaatgctaactagagttgcctaatgaatcaaaaaaatggcaaatgcttaaaattcaggaaaatacagataagacctattatttattgttgtagttgaatattctgttgagatgggactggttatcaaagatgtcctttgtactctacgtggcttttcgaatgtcagctctattttctcggagagatgggctactgtgtctaggcttggagatagccatatagcttgaatagaaccccagacgagctgatcgtgcagatgtcatgtggcatccactgaggtcaagaggaaggagtggctttgcctttattttctttattttcctttctgatgaatgacctcaagggcacacttcatacaactttaagcttagaccagagaactcctatagtctgctaaagtggatgctgttggaagggctgcctcactcacacttcttccagaagattctgctacgtattgtcagtttgcctcagtgtttttcctacaccacattcctggggtaaaacaactcagatctgaatgataactttgcttgaatgcatgttcgtcaacaagaaaggcagaaatcataccatctgaaagggggtatcccctttaattatttcaagccttagtcacataggtcctccttctgattgtttaatataaaatgagagatgtaagttctccaaaaactctgcttgtatcttctatttttgagaaatgatttaagtgcatttaaaagcttagtctctgcttgcccagaatgcttgctcttcaaaatatctgctccccggagaggtaaactcaagttagtcttttcatgtgactctggatcgttgacctggaagacttcggggtaatggaatgggctttggcactgatcgctgttttctggttgagtacccagcctggaaaggaaggcgtgactgagccatgtgcaaagggggagggtgggtggagtctaacgatgtttgaagcatgagtacaccttcatttgatgcctcgatttactgagggagagaactctaaactgctgcatccatggatggatggaagtgcctcagcttgtaaggatgcttatttaaatgattttgcatattcaaatgattctacagccaatcaaacgcattcattccctgcctggtgagtgaaaactgaatgacacttgtgctccctctgaaaggaacagacgttttcattatcaaattcaaccaagcagaaaatctggcgaagggagcagaaatctccatttatttacatctaccatcgactgtttggtgataggagattagtaggttgaggaagagccttgttctcatttagctatgtgaccctagacttttgtctccttgaaaatacttacttaggttatgagcatgaagccaaccaaaagtctcaaattgtgcatatatatttaattctctatagatatttctggtgcttgtgggcagagagaagtcctagtcacatattaacattctatgtcttccttatactttaaagccattgcttatcagctgtaaaagcttaactgctgcctttatgttctgttagcagagtgtccccatctgacttccattttatttgcatcagccggtgtagttcatcataaaagtctgcattagagaagtggatcagaaccctccaggggaatttgctgccaaagcatagttagagatctaccttttgaatcctccatataattctttcttgcccaaacctttctccgtacaagtccaggaattcaattatttcagctctctgaggagcagtaagctccagaaaattgatttgcaataatgaaactaagccttgtttacaaatctgagtggcactttcgaagactggactggcatggtgacaggaggagggtacgaatttatctaggggctcaccccctttgaaaagatcatgtttgtggaaacacggctggaaaggatataggtaatttctaaaagaccttgatgggtcatgttttaatctgcttcctttttaattctattatctcctgtgttgctcatccctaggtgtgctgctgagagcgagtgctttaagagagtgagtgctgatagctgaccatagtgctctgatgcccagttaaaagctgagccagtttcaaggggtatggcctcatttctttgcagttgacttgttaagtgctgtgacatttttttcccattctcttctttctccccataagatatttgacccagtgagaaatgggccatttttctttgcgtacatgggatttgaaaagctggttggacaccatgacgtctctatgtgtctagccggtgactagaaatgccaaaagagaggtcagccttggaagagtagagaaagtgactgaatccttaggcccgagtggtattcctgagtgacagtggaaaatgagcagagggcagagctttgtgcaatcaggactgttaaaaagtgggtgggggggcggcactgagagtgagcttcacacagaaagcggagaacaagagcggtctggcttgcggagaagcgggaggagaggactgaagctacaagaagacggtggtgtgatggagtggtcagggaacacggggactgagaccaaagcatttggtgttgaccttgaacgaactgttgtcgatcgtcatgtgctgagccacgtggaaaggatcggaaagattccggcaaggtttagagaatgacggacggactagagctcgggcagaaactctctaagtgcctcttcctgtcttgattatagcctgcctcacacaggggtttctggatctggcacatggaagaccgggctgtgtactttttcttcccactgtgatgtcaggttttgctaatgactggtggttgtcgtgcctcactgtacctcagcctggttggcgttttgtaagtaattatgtgggttttttttcttctctttccttttttttaaagcaccgcatataactctaattaattacatcttttttttttaatctatgtggctttgaaaaaaatttttttaatgaggcagaaaaagaaaagcgtttggggaaagcggccagcgaggatatttgtgtttcaggagacaatgtaatataggacggtgtctctgcagggtccactttttagctcctaggaaacaagaatgagtttaaccaaaggaggctgaggcctggtgggaaccgacgtccttcggtttccatagcggagctagtcacatatcctataaatacaaaatataataacagcagaactgtcgaaagtggaggagggagaaaggcaggtatggtaagcactgattagggtggtaacaaagcgaatcctggaggcgcatctctcagcatctatgccgtttacgctcacacgatgaacagtatactcacatagtaaaaccgtgcagtatcagtggacagttgcattcagatccagactcctgttcctctactaacccctgtcttgggcttcacatgttctcccaaaacccctacctgtccgaatttagctcatgggtcctcaaaagaaattcccgatctttaaaatcctatggaaggtgtcttgtgctcactgccagccaccagccactagtggccatacaatactgaagacagctactccagacagctttgcaggtataaaggcaaaccgtggagcaaaggaaaatacagcatgctttaataagtatttgtgcaatggtttcacgttgaaaagacaaaatataggatgcataaataaaatatgttcccagagtgaatttagtatatattgagtatggaaaaatgcatactgctttttagaatgtgcctgaaaccacatatgtgagctactttttatttctgttgggcctgactgctcttggtgcacactgcttgcatatgcctcatttctcccatcttctacggatacagctccaggacaggttagcatttagtggtacccactgatgttgagtagccacttaaaattgcatcacatcatgttagatttcgatgtttattttcattactctttgaatttctctggccagtaagccttttttagagtgtctccactatgaaaaactgagcattcttatcataaaacctgaaattccaaaagcttcataattggggactttctagatgccacatcctgccataaatggaaaatcctatactgtaaaaacttgtttcttgtccaaactatgaaaggaattgcagagggtcagtgtggcctcatgtgtaagcccagcattctggaagtagagacaggaggggggagtattcaagatactgaaaaaacaaaaatgtggtaaaattgctggagaagtggccaattttaagaaccgggcagtagataaacaagaagaccctacagcatcttgtcagaatcataaagtctgtgcaggggggtatgcccgatgagtacaggagacaactcccaatagctaaaggtggaccaatttaggcacacaaacataatatgtacactgtatgtgaaatataacacatatactcacacacacactttcatttttaaagaaagtcattacacggagcccacgactgggatggagaatcacgccccacttttcctaggttagagtttatatgtgtaaagtatttagaattcttctgaataggagattatctttttttttcccagtgtttcatcacttagactaatgaattttcctattatacgtcgatatttaattctgtcctgcacagtgtgtgtgtgtgtgtgtatgtgtgcacacacaagcacacatgctcactttatataacccctataaaaactttgtgattccaacaagatgctgtagggttgtcctttatcttctccacaaatctaagaatcaatcatttctccagagtcctgtttccttttgttggagaataatagaaagatccaatatctaggctttgtgtgctcattgctgctgaagtgtctgctttgttgctgatggaccgaggaagtccccttgctactcctcgatcttatagtatggattcctgtagatatttctgtagctctctgtgtctcaattagcatccctaggagctcaccctgttgatccctctatcacccactggactgttctacttcccgtgcttgtctgtaaactctcaccccactgtgagcatctgccttccacccaccttcctttgcctccaccatttaattcagaatgctctgatgacaacatcacaattacagtactttaaattgtgaaagctctttaaaaaatcctaaaattgttagccattgttgatcactatactttgaaaaaatatcattattatttcaaaacaattattgttaacagagaggtacaggtagtctgtttctcttgaacacccatctcacggttagtgtgttcacgaacgtgagcacatctgcgtgtggtatgtatgtgaggcagaactctcctcacctgaatgagtctgaaagacttaaaggaaacttttagtgctcacttcttggcttgcagcttgcttgaaacattcactcagcttctgccatctgccaaattgttctctgaagaaacccagctgccagctgttattgtaatagttacggtgacactcggggtgacagcacagccactttacagaaccgagtcatttactcatgtgttcctgagaacccagaggtgaccctcaccatgaagcaaaactctgcctcatgccgagccagttgagaggcattttggtgaaatacacttctgaaaacattctttccacacaaatgcctcccggagccgtttgccagctggttgtcagcgtgcgccacttatagggcgtcagtccatctaacgtgctgaaacaaaatatatatatatatttaaataaattttccaagtaaatatgagtaaacatttcttcggtctgtagctatcactttggtatgtacatatgcagtgtgaactaaagcgcacataaatctagagtgggtatttgtacgtttgcgaatttatggggacatgtgagacacatctgatcctgggcatctccatccggtgtgaagtggcttctagtttgtgaggcaggagtaggcaggctttgtttctttcctcccggatcttttcagtttgacttccattctaaactcttcatcctagtctgaggtggtgtcacttttcccgtggataaggtcaacagcaccagcctagtcagctatgatgctaatgacaggcgaacatgcccatctccctgtgttcctcaaaagtgctgaccagatttgtagctgaacactgtgtagcctgccctcacccacccatgagctcatgcaaattgctcttctctgagaattcaccccctcctgtttttgtctggattcataggcatgcgtttgctagggacttctgtaccctgttgctctgtggctggaatgtcttctgtcaacgtaggatgtttttctcttcccttttctcgctttctccagcgcattctcaacctattcgctctcacgacccagtaaagttctccaccttgtctctcagattagtccctactccagttcctccactttttctccatcatatttctcaccagccaacagtttctttcttattatcatgttcctctagagtgctactttattgcatctcttgtcggtttcctggattctcagccctaggagaaatgtaaataacttgcaatgaagacttgtgttaggggtggactgaggttcttgggagaggtgtttgaagatacccagacttctcttaagaaccaccatcatcgtgagacttggaggctcactgctctcatcctgggcctctgcctccctctgcagagctctaccggagctgttatctagcatacgtgatgttcaaatgtacaacgcaccacttcatctgtgaggctccacagagctccacagaatagctataataaacgtggttctcttgcttgcagcttttcctttgaaatcattttattcaaaaacccattctgactgtccaaaacagtcctagttctgagaaaaaaatttctcaattgtctcacactggttccttcttattttcccctgtggggcgaactggtgggggtcccctcatgtttctgatagtggatgtttatactcctaatactacctcattgctgggatcttttttctgtaaagtcacaatataataattagaagtgcatccctgcccttgaatgcacggtactgcagaatctacctttcacaggtttcatagccaccattccctctccttttctcaaacgttctcttgtgtaagggaaccttatacagtaagctcactggcaaatactttctgctcacttccattgcaactcaattcgagcagctaagacagtgggtaaaaatgcagcccgttggcgggggatcacttggagggagagtctccctccctggtaacaccgggaaactgcagagcaggaaaccgcccatccttgctccattccgccgggagcgtgaccgtgaggttataggttcccatggacagtctatcttgtgactacagagcccggtgtcacacagtcgcactgtgttcaagtcactgttcgatgggttctaactgatgcagcagaatgcattcccggcccgttcatttggatgactggacattttagtctcattcttttctaatggccagactgatcagatcataacattaaaatatttcacgggcttaggataaatcattttcttatatcaaagccaagggagattggccatgtaaaccatggtgacccgagtttcaatgagtcaaggtatctctggaaggccagagagcagggacacgtgaaatttcagctcagctctgctgcctgctggccctgtgagcgaaccactgacctgcacttcttcctgcccatctacaaaatgaggtaattcaggttagaggtctgttctccccgacaccagagccagcactgcacgcctgcaggggccctgttgatttccacatctttgttttcttgccaagacatcagccaagtgtgcattttatctactttaaaaaccctctctcctctgaaatttgcatatgtgctttaaatatgaaattctttttttctttcacataaaaacagtttgcatggctaccaaaaaacatgcccagtgtgtattggagaatttttctgtttagagtaaacgttgccttatttcccacaatatgtagacgcggtgagcacagcttctccttccgattctctgtttaatttgaacattggctgccttcatctgaattctgttaagaaatgctcgctcttgaagcatgagtccacataaacaggtttatttccaaacccaaagcacccatccttgtgtatggaaaccccaggttatacctatcatagactttttaaaaaaaaaaatcaataaattttgatttacatattactctcagtctatatcaaaacatccatctttcccgtaaaactaaactatgttctagcatagactttgttaaaaaattaatttttaacaaaattcaatcctctcaattcttaaagaatttttttgctatttatttccatctttaattgtattatgtggataattctcagtaggacaatctgtgcacgaatgcagatattcacagttgtcagaggtgtcgggtcgcaacggagcaggacatactggatgctagggactgaactcaacaacagtagccctcttaactcctgagccatctctccaggctctctctctctctctctctctctctctctctctctctctgggagagatttttataatttagccttctaaccttcttgatgagtggcattctaatatgctttcccaaccctcaggggacgataagaaaggctgtccactggtaaatttcactttaatgatagggcacagtgagcttccattttgccctttgtcctgaggccttttaaagtagctcgtgttaatcctttgctagagcaatttttcgttagctataggcaataccagcaacttacagttaagtaaaataatttgcaaattaaaaattccagtatccttttaaaatagaatgaacagttgttagactgtaagcatctctcagtgactggctcagcactgtcatcgagccctggacagacgaaaaccgatggatttgattttgtttcttggcaccagtttttctatttgtacccccaagaactcatttaggccatggaccagaacatcttatgttttcttttgatattctaaaaatggattcaatattaacagtcagcatttaataataggccagcatttaatctgtccaataattacttatgaaacaggaaaacatcacagatgcaaatatggctgaccatgttaactaaggagggtggctatattaagggttgtggtcacttttgtcttcctataccctattttcctgaaatacctcagtgaataggcatttcctggccgccaggattggttacctgacttcctcagacagcctgagtagttcacctgggaacggtccttcctcatagatggtatctgtttagctctggaactaggttacaacctcctgtggtccacactgccttaggcaggtttctttgcagaggtttctcactagggaagtggatttgtaggagatgacatcatggctctgtgtggagtaagatgcatgatgcagctgcagaagtgggaagttttgaagtgccctttgcccttcccttcctccagtacaagcatgcttgccagagctgtgtcaggggtagggatggaatagtctgatggccagcattaatccacagaatctagaatcacctgggagattggcctatgagcatgcctgtggttgattatcttattatgttaactaggatggaacaagtggcccactgtgggtggcaccattcccttgccgggatcctgtgctgcatgtgtggaacaggggagcagaggagcctgttgtattccacattctctgcttcctggtagtggatgtcacagctgtgtgagagactgtctttctttcccaccatgatggaccctatgtgcccttggatcctaagacagagtcagctctttctcccttaggtcatatttgtcagagagtttttatttttacagcagggaaaatcagatgataaatgaggtgctgtccatacattgtgaaacttatcttcatgacctactctacccatccacttagactaacctttagtgatatttctacctgaagacattcccctgtgcacccggtcagattcattcactgtattgacctaggacttgcttcattctggtatgaaaagaaatctcttcattcttcaacagacattcattgtctagtagatgcagactttgtgctgaagcagaggaatgccacaatggacaaaaccaagagcaactaatttcacagcttatgttatttttcactgtcaatcttttaccctcatgactatgtatgaacatgcatgaacatgtatgtatgtgtatacaggaagggtgatatgtaacattcctaaccctggagtaccagtcaggcttaggagcctttctcatgagatgtaagttcaaagaaaacaagattccataatttgaatgaattactctttccagagtgtttttatataaacacatatataatacacattgtgtatgtacagattggagcttaacatttaaaaatgctgcagtctctaacaatttgcaagcagtttaaatttacaaaatacagaaacagacattggtgttgacagtgctcaaattaaagctatctgtttttgtactgtaatccttaatgacaacgaatgtcagtggctacttgtgcagctgctatatggatgcagaaactgaaattaattcaaggagaaggcactgggaatatatagggaacatacagccatcaaggatgcatgcatagggaatgtatggacataaggtcttcatggtagcaaggcagtcggttgtttaaagaggctgacccaccatgctaaaggtagtgtagcctttgtggggtttttcgtgcattgaaagttctgggtaagttctctgacctccgtcgagcccgtgtgtgtccatggtgaaatcagctgtcatacgcgaatgatacaggtccactctcctctctttcagttggtgagtttgtgagcgacgcccttctcgtgcccgacaagtgcaagttcctacaccaggagcggatggatgtttgtgagacccatcttcactggcacaccgtcgccaaagaggtaccaatctgtgcccgctttcctgcagagcgatctccttgggggaggggggaatacaaagatgtttttagagggttgttgaaggcagtaagttcttggtggttttttgtttttgtttttgtttttcgagacagggcttctctgtatagccctggctgtcctggtactcactctgtagaccaggctggcctcgaactcagaaatccacctgcctctgcctcctgagtgctgggattaaaggcgagtgctaccatgcccggtggcagaaagttctttatggaagcaatgttcaagcattttaaaactgaatttactttttaaagtaattttatttttttggcaaggtcaccactgaacagaaagtctaatgagctaccctgaaccatgtctgtacacgtttgtgcttctctatccatgaacagccctcatggtcagcaatagctctcattagatacatctctgggctacatcttacagatgaacataaagctgtcatgtttaataggcatatgtaaccttacattgagcatctttctctatttattttctaccatcgctcttgtcccatgtggtttgcataatttaactagctactggtgaatgagctggtagaacaaggaagccacatgttcaaggccacctgaggccacagtcgttaaagtcataccctctcctgccaccttcctttccacggtgagcgcatctggggtagcacgcgcagccctttgctagcctctgctttgggctaagtcagtggaatattaaggacaatagaatgtagtgaatcgtcacccttagaaccgcactgtaccctccatataattataatgcttttctcctaagtagttatgtcaagatgggggagccagtgttctagaattagggtcctttatctagctcaggagttcactaccagcgtcagttttgtacccctgttccttcctaggaacatttttgcttgtctgacctgtagaggcactaccactggcaggtaacagtcaaagaccaacagctaaaaaccctcccaggaacagggtagactccacctggcgacgtttcttttccacattaatcccatggaggctgagctataatagccctctgagctatatccaaggccttgtttctaaagtgcttctgagatccaaagtagagtcttgctaaggggctcactttggtcttgatattgcactataattcaatcaggccatgaacttgccacagccttccaagtagccagaattatagactagatgcactaggcctggctcctcagcaaattaatttagtccaaaatatcaaatacgttggttgacgaattaaagggagaaaaagggtttaacttgacttttatatttcatgaaagagtgtgctctgattcactgtaaaaacaaaactttctttatctaaaaatgattttggaagtggaatagctgcctgagcttacagtagactacatcctttgaagcccagcttcccaaatgataacctcactttgcgcttcctctgagtttgcaaaggaagactcccttgctactacgaaacaacaaactggtgattcctgtggggttaaaatgcatctataatacttttactgtttccctaggcatgttgaattattaattttttttctctgtcacggggaaatagtttctcagtttttctcttcgtgccgatttctgcaaaattaacagatcccaggcaatcaaaaagatactgaaagagaaatcagggctgtggagggcagtttcttccttcctgggactgggactctgagatatgagccaagagacaccatttccagaataagatgcaactaactgcctataaaaaaaaattctatatctggggtagagaaaagaggggataggcaaatgtagacggagccttcaattcctgaaaagccatcacagcccaaaacgtaaatcatttcctgatatttgtccccgtgtttagctttctggaacctgctttcttttcatgtttactttgtaaacataatacattaaaaaatgtttttaggtatatttatttcattttatgtatatattgtatatattgcctgcatatatgtatatgcacaggtctgtggctggtgcccataggccagagtcaaaattgggtattagatccatggacctggcggtgggtacggttctaaaccatgggtcaggggtctgctacaagaacaacaaatgcctttaaccacttaggccatctctcaaccccacctaccaagaaaacaatataaagatagaataccaggcagcccttgctgaacaccgggttagaaacgagttcagacagcaagccgcccttaccttctggagtaggctccaaatctatctgtccatgctgattttcctggctgtgacggcggttcaattgttccagctgtggttgtgttcgattatctgcgcagtgactgcgtttgattgttccagctgtggcagtgttcgattgtctggtctgtggctgtgttctattgttccaactgtggcgtgttcgattgcccgggctgtggctgtgttcgattgtgtggaccatggctgctgtccgactcttctagctgtggttcgattgtccgggctgtggctgtgttcgattgtccgggctgtggctgtgttcgattgtctgggctgtggctgtagtccgactgtccttgctgcggttccattgtcctggctgcggctgcggtccgcttgcctctgtgcccacactgactcctccttccttttgtagacatgcagcgagaagagcactaacttgcacgactatggcatgctgctgccctgcggcatcgacaagttccgaggggtagagtttgtatgctgcccgttggccgaggaaagcgacagcgtggattctgcggatgcagaggaggatgactctgatgtctggtggggtggagcggacacagactacgctgatggcgggtaaggcggcttttgagatgggtctcagattggctgagccatctcgtctcttacagtttttgtattctctgagtgtgtctctctgtctcacagtggaaagagacctctcactccagttatatttgataataccagaaaaatctaaccctgaagggctgctctgattcttgtatgccacttactgttagtgttactgataaaccttcatgaagtcattggaccacgtttgaatgtcaggaatactgatcagactccactcagagctgctcctcagtaggtctaccaggaagctagtagatttgagctcagcactctggcatgccattttgtcctgccatttggaaatatttttttattagataatttctttatttacatttcaaatgttatctcctttcctggtttcccctccgaaaaccccctatcccttccaccctccccctgctcaccaacccacccactcccacttccctgtcctgtcattcctctacactggggcatagagccttcacaggaccaagggcctctctgcccattgatgtccaacaaggccatagtctgctacataggcagctggagccatgggtccctccatgtgtgctctttggttggtggtttagtccctggaagctctgggggtattggttagttcatattgttgttcctcctatggggctgcaaaccccttcagctctttgggtcctttctctagctccttcattggggaccttgtgctcagtccaatggttggctgagagcatccacctctgtatttgtcaggcactggcagagcctgtcacgagacagccccatcagactcctgttagcaagcacttcttgatatccacaatagtgtctgggtttagtgactggcctctctccctatctattcaataccgtacttaaaaatacttttaaacactctttcgtgaactcaatacaaatttttggttaaggaagacatggtttgtgtttgtatatttactcttaaggatttccttcttctttgcttttggtttggttttggatgggtgggtagacccctcccctcaaccatctttttcctttgtgtagtgagcaacactaataaatgtttgcggaagttctttaactatctccagttgcgtgattgctggttgacattttttttttgcctcattttccttgggatcttaaccccttcgttaattttctgactcttttcacttgtgcacaaatatccatattcaaatcataagtctatgaagccagaatttttgagttagacctatgacccggtttgttgatgaatccaggctatcctatccctgaaatgtaaggctcgggctttcctgccaaggtcctctcagctgttcctcagggttttctagctcaaacggaacaccaaccaaaaatcacaaaacttactatcagtaagatgaggcttcattttagtactagctgcctgagtttatcaggacgtgtgtgtgtgtgtgtgtgcgcgcgcgtgtgttacagtcttttatatcccctctttaccatttactttcatccatctatctatttgagtcaggatagaggctacatagagaggatacatacaggatagaggctgcatgtagccctggctggccaggactagctatgtagaataggctggcccagaactaagagctctagctgccactgccttctgggtgttggaattaaaggcttgcactacttactacatccaggtaattgtcttgctcccccacctctcaaaataattacatttgatctagcttgacatagagccaaggaaactgaaaaaaagattttcagatacttctcggtgatgtaaaagttcaccacctatgcataagtctcgtgtttcccaggcaagaagtctccgggaagcagaatttgcttctgagatttctgtcatctaatgagttaggggttccccataatggcttgacaacccaccccctatacttctgttctatgtaccacatgtgggacaggaatgggttaaacttaattatctctctctctttttagaaacgaggtggcctagttctcccttattaagcccactcctaccctccttggccacatctagatttgaacgtttcagaggcttcggaaacaaatcccatccttaggcgtctgatcacagaaccagtacaaccagcattcctaaaggaaaatctagttacttagcctggacgttgtctgttttcataagctactggatatttgatttgctaatttccagtgagtaacctgactatggattgagaaagtatgcagaatggtatttaaacttggaaacttccatggctggtgttaaaactctaaggcactagatatgtatttgtaaccatcttgttaaccatcaaccttgtgctgatgtcacagggaacatgtgtatgtgtgtgtgtgtgtgtgtagagtttagagttcaacactgagtgtttttctcaactatcctccacctaattttttttatacttagacaccaaggctcaaactcaggctgtcaagcatttaatcaaacccctacctcccagccccagcagggactttttaaattttaaaatgattatttttattttcttgaaagccaccagcctctgccaagcttcttccacatgtaagacatgttctatgcctcgtaaaaccttctttttaagatgggtccagttttcctcaggttttgatcttttcatcctacacttttttctgagatactgacaccattgccacggtatcagtggccctttctcctgctgctggaaactgatcccggcagatggctttgcattctgacccaggtctctagtctattcaccacgtcactgggtaattgtaccttcttgatacccatctctgagtctatgacttcttttagttctcactgttacaactcccaagctaggagacatttgttttcctcctttgaatgtgctgtgtttgaatgtgctatgctacctcctagagaaggggtatagtatgttatctaaaccagagagaacactcagaccccagccaccccctgcgtgggtaatatggtcaccctgtcatcatcatcaacttgaaatgcaagctggctcctctcctaattatcttcctttgtattctgtctcatgttccaactccctcatcccttggagacggtgcacgcttagtattcccaaccattacatctgaaccactcaccgggtcttgctgcctttcagactcatcatcacagcagcagcatgcaacccgtcgacctttcctttcttttgcccatgatcaatccggacagactgaaccactcacatataccccacacatcctagacttgcagagatgttcacatttcccaaatatattttggtcagttctcaatgccggggaaaacttaacttcttcctgtaaccacttccgaatttcctgagctatcgagttgtgtaactgagccggttgattccacgtcgtaacagcagctgaaaccttaatgtttctggatgctcctgattactgtccccatttgaggacagatcatcgtctaccaagccatcaatccaaaccaactgccttggtccctagcatcacctttcttccttgctgtatctatgaccctttcatagctaacctctgtggatgtctagagcaaggtacctggcatttggtggacactcatgtgcaagtctcctttgctacctaaatatctcctgtcccttattcttctagcctggattcctggttaccccccaccccccaactccctccattaccctttccatctcactggctccacctcctttacctctaaacctgctctttctggaatgattattctctggtactcccttccttattttgggagcacaccaatgaaagtggtgatctcgtactgtcccatccttctcggcaggcccatcactgctccatttttaggtttctggggtttatttggaatagttagcgaatgacggtgacatacttcttgggatgtcaaaataagaaaatgtcgtaacctaggaaaactgaggtcaggaccctgcatgtgtcctggatgtacgatacgttacggtggacttgtatgataactgtacaataaaatgagttttgcttaattattattatttttctccaagaaagagttaaagttcagaaatactattccttcttagagttacttacactgctcagaaaggtagcaagtgctgggattccaagagttaacagcccatcagttcctgagagtttgtcacttggcaagtggaaacacctggcataattgtgtaaacattaggtgctcaacaaatatttgagtagaattggagtggccctgacatcaaatccgtacagaggcgcagtcattgtcaccaaaggtcagcacatatacacaaagtgattggtataaagaaaaaggaaaacccaaacaaacagcagaggaacatcattcttggtaggcaatgattacatgaaattgcatcagaaatccctgaagctagaaattgtattgaaaaatgtactgagaccaaaggaaaattaatcctttcttaatgacctttaatgtggagcctacatgaatacctcattcaaaaaagtgtgataaagttagaaataaagacaagattacttttcttagaccctagggtaaaagtcagtttgtgtttgtgtttggtttggtttgtgtgtttggcaggaccaaccattgtacctaaagctagggtgggggtgctttaccaccgacgttcagcatttgcccttttattactatttgtttttaatttccgctggcgacagactctccctctgcagtacagggagccttcggctttctgtacacttgcatcagcttccggattagccaggattattggggctgtgcaaccacactggctcctgaagtccattcttagacaaacttcttcctttggaatcagtaagttccttttgtttctgtcaacttggagtgcttaaaaaaaaatcaaacaaacaaacaaaacctgtaggtaaaatcccagtaaatacaagttatatgcatgggactaccagctgttggcaagcattctgtgatttgagaaacaaacttcagtgaagagcagtatttcccaatggtgaacgattttcactcaaggggcatctggaaatgtctgccggcagtttgagttgtcacagtgtgggtagtgtgagagaaatgtcattgtcatcaagggggctagggatgatgacactgccaaacatcccacagtgtataggacatccctatgacattgtggagtgtgctggggttaagggcccccaatttggaggcaagaaagatgctccaaggccaagagtacatgttgctcttgcagaggacttgggtttggttccgagcatccgcatggcagggcacaggcatctgtaactctagttccagggcctctgccatcctcatttagcttccatgggcactacatgcatacgctgtgcacacatacatgcaggcaaaacattgtacacatagaaaaatatatatcaatctaaattaaaaccagttttttttccccaagtgtcagggttcatacctatagacccagcgcttgggagacaaacacaggagttttctgggagttcaaggttacctgggccacagagcttgttctaggccagccaagactgcataataagactccatccaacaaaacaaaacaaaacaaaacaaaacaaaacaaaacaggggggggaaaacctctatttgaaggtttgtttaccatttaacttttagggaacctactctccattcaaggctctgcctctaattctgcatggacaaagaagcaaccatctacccaccttgagagtcttcctctaaagtacagtttggggatttttttatccctccctctctctctccttcgttctctctctcccttccttcttccctcccttcctcctctcttcttcctctctccttcctattctctccctgctccttcccattctccctctgttcctccttccctccctccctccctccctccctccctccctccctccctccctccctccctccttccttccttccctccttccctccctccctcccttccgtccatccatctaaataaaccttcctagcctcagctgcagccttaaaattctgtcatcaaaatgtgcttaagtgcagggaacttttattgagacttctcatttgtaccaaattattttatgaatctatgatctcagttttgctactgtaaactaccattatactttgggagggggtgttgtagcttaagatattcagtgaattttaaaagcatgagagagggagaaaaaaaaaagcatgagagaatcttaatgaccattgcattccatttgaatttttttaaagctgtcagatgaggggcaaattattatggtttgatctgattgtaagttttggtccatatagatttacttatagctaaaacaaaaactttaatcctaaagtattaccatcatgtactttgcattcaaagtcttactgtttactccttgagttctgtttattatggttcatcgtctgtttttatcccactgtgagatgttacacaggtggtcaatgcagagcacagacttccatgaactcttccttaatcaccccttgtaggcaggataggaagttcacattaaggacttgtttgtaaagcagcactctgctaggtatagtgactgaaaaatcactgtcattatggcctctgtaccccaagatcctctcagacattaatagccacatgactttatagagtaagttttatttgaccatctatcttctcctttatatctgtggagtccaagttcttagaatagtcttgttcagtttctgccttgggctttaagaaaaggctactcaaggctgacgggagaagaaaacaccacggatgttagacggacaccaagtgaatcacacaaatgatgaacgaaggtctggagtctttgtcagtggatgagtcgagtctgaatggaaccgatgaagcagcgcatggctttgcgatgtgactgtcacagtgctggcttggcagcttccagagctgggctgggctgtctgcctctggtctgaataaaggaactaacttgacaatgatgacgaggagaattgcagagacttgtacttgcccttgaggacactggccgccactaccaaggccttattagaaatgctgtctctaaagttaataaacttggatcgcatatacattcagaaaaaaaaaaacaaatcacgttaatagtcttcaccggattccagacgatgtgaggccaagccagtggggtttgtttcggtttctgagcaggagatggcagagagaagagcgtttttcctgtataggacttggctgctggtatctgaggtacagttggtactgcattgagcacaaggtgcccactaatagaaagtcatctgatgacataacccacactcttggaagtgttattttaagggctgggttattcagtgatggtgatttcaggaccgtggtccacggtcagagagtaagacaagagaagaagatatagattcttgttgttttgactggatacagtgactcgcacccacaagagctaatttcctgatgaagctgggatcaagataatgtcatctctagagtaaaatcccttgtttgtatggaatttatcaccgtctcatgtcaaagtcatgacatttaaaatctttaatttacgtattaagttgttatggcaaaagatatttctcttactagaactacacggcatgaagcggtgccaatcgctttctgtaagaaactcagcaaaatgtgaaagcatgtagttcggtagaaggaagtcagtctttaggcaagtgtgaaaccacatcctctcacttcccatatttatgaactaacattttaagggaaccggtgaaattaattgtgaaactagagatggtgggcatgcccaattttgttgaagccaggacatgagtgtgtccaagtagatgaggaaaggggagccctgttagcaaataagatcgtctggctttgcaatcgatgacccttagacagagagactcacacggggcgaatcgcagagaagaagagaccgtagtgttcagccataaatgacatctgtgccatgctcccatggctcagggatcatcacagaacgtataagagccaaaggttgcagagcactacttcaagaaagggttcctttggacatcataggcttcgctgcccatgtgaacccatagcagctgtgactacatgcagaagacctgtgtaagatcaagccagtcagaactctaatgtagggactggaaggactcaggaagccccactcctagttgaacagctattgacaatggaaaacttcactgagagggtgtgtcagttttcttcaggggtgcaggccagggtaggctgcccatgcaccagtggctggccctatgcttaggcacataccagcagcaccgcaccagctagactgcctggttaatatgttaataaatagcaagcacatgaagttgtgaggtagctttggaaggaagagacataagagggggcagagaggtaagatggtctgaatttcatcaagacattataaacatggatgaaaatctcaaagaataatttaaaatatacatttttttaaaacatgctttaaccctagcatatctgtttgcgcctctttcctctgacaggggtaatgttagataacttgtatcacagtgctttttggtctactgactaatgtacggacacatttataacgtgtagactggatcccgaagggaggtaaacccctatggagctgatctgtagaccaccccaccccaaccctgtctcgttctgccaaattataaaagcactcttcggggtgtggagcccagtgtcctacatctgctcaataatcatgaccagtatactgtgttcttctctcagtcgactcttaaggctttgtcactgttgtaactgatactgagagatgagcacatctcagacctcttgtcttagatgaggctgagaacatcttaaagcagctgttggtagcaagcgagtgatgatactccttttttatatgcctgttttatctcttaaatatccaagaattattttaaagatgcaaaaaaaggaccaaaatataagattccctatgactggaaattgcccattaaattagttgtggttgactttggttctcttggatatttttaaatagaaacttaatgactgtttaaactttcaatttccacatctgaaaaccttccattttatatctcagttatatatttccgaaatagagaagaattgcaagtaagagcagattaagtttttaatcttctgccccctggaatatgctgttcatcggcttcccattgtagaaccgttgattgtcatgttaatcggccttcagcagaattttatagccagtgttgttagagctggagctgagttgtacaagtatcagatgtagtaatgaaagactttggctttatgaaaatgtgtgtccagggtattcctgggacagcggcacctcatttaattgaggagtatgcaggtcctaagtccattgacacagcattgccaggcacctatcccacaaggctccagacccatccactactcatgcaatactcatgcaatactcatgctgacactcccttagcaatgcaggacatagagcatctgaaaccgggaggccttctaagtcccttcagcttgacagtattgtttctacccatgcaaattgggaattgaccatatagccattttagatacacatttatgacatccatagtctctgatttaaccccctacattgaatggggatttttgttgttgttggttttttttttttttttgttttttgtttttgttttttttctctgtcatcaacacaagtgacaggcttttccttggattccctggattttaaccgtcaggtaccagtacatgcacacacaggcccaggcatctgtgggcacaggagttcgagcaaccatagcagaccacggaaagcttagaaggtccttggaatcctttatttcctctccatatctgacttacctatcctactattaccagcctgctcttcttgtgtgctcttcagtcaaggcattgattgggtcttttgtttattggattataactacctgctctctctttttgtctttgattgtaaatattagttaaggcaaatagttcaagacttacttctgtagcctggaagacctcgttattttacagataaatgaattccagtgcatacgggtgttgttattggctgctggcccccagccccagttgggttccgtgatatctgttctatctttagaaacactccttgaagtattagagcccagggctctgcactgttacttctgcaaattctgccaggtttgcttcacctaatctgtttatcctgtccaaatacaatcttagtctaaagtaccttaaaagacaaccaaaattagtaccctcctaaagtcttatcattaactttctcctatgcattcatacttcttcaacatacagattgaaagcttatagcctctatagagcagctacagtgtggaacacgtgaatacataaccctgatgtagaactccccaacatgctttggtgagttcccaacatactaaagagccaatatgcagggtgaatgcagggaagtcttgcttgaagcaatgtaagtggatacagttacagagattgtttttgtgccaagccctcatgtaatctatgattctgtgtgtgtgtgttcctgttgtatatatgcaggtgaatgtatgtgtgcatatgtatgtggaaaccagagaacaaatttggctattgttcctcaagtgctgtcaaccttgtttttagagacaggctaccactggcgtagagctcatcgaataagctgagctggccagtctgtgagccccagagatcatttgatcctaacctccccactctgagattataaatgtggagcaccattcccagccatacatatatatgtatgtaaacattacatacatatgctgggatttgaggagggaaatccttcccttgagagggaaacaccttctgggtgtcagccctctatttcctccccaaccccccacttccccacacatatcaagtctctgcaggactaggcacagcctttcccactgaggccaggtaaggctgtccatttagggatgcaggatctataggcaggcaagcagacaacaggctcaggaacagcctctgccccagttgtttaggggtcccacatgaataccaagctgctcatctgctacatatgtatgggggagagaagggggctaggtccagcctgtgctcatgctttagttggtcaatctctgggagctctcaaggatccaggttagttgactgttggtcttcctgtggagtctctgtcctctgtggctctcccaacatttctcccaactcttccataagactcctcaagctccatctcatgtttggatgtgagtttctgcatctcttcccattggctgctgggtggagcctgttagagaaagttatgctaggctcctgtctgcaagcataatgtcagttagttagtaatgtcagggattggttcttgcccctgggatgggactcaagttgaggcagtttggttacctattcccgcagtctctgttacctttgtccctgcacatcctgtaggcaggacatattttgggtcaaaggctttgtgggtgagttgctgcccctatccctccactggggatagttgcctagttacaggaagtagcaatatcagaatccattcacagctagagttgcccccttagaccctctgaggcttctcccatcgtaggtctctggcacttcctagagatcgcccctgccctcagctgatctctgttccctctcccttcttctccctacatatgacctagccccactcccctcccacaggaacagacaagtctccctgcctgtagtcctcttcccctgacaggctcatggccagtttggtgttttgttttgttttgttttgttttgttttgttttgttttgttttgttttgtttttgtcttggatatcagctccttgtttcacagaaatgaaaggagtcacccttttcagaagatccaggcttcactatttcagtcttggcatcccgtctgtgtgtcctgacactgaccccgcgcttcagcattttatttgctccttgtctttttctcctccagtggaatgcgcaccatgaggaggggcaacttactctccttgtccctttgggaacctcatatctgactcaagttctagcgcacgttatccaccggctaacgttatccatcttcttgtgtccattgtctgtggttttggcttccacgatctaaaaatattagttggaagtatctaaaaataagattcgtaaacttttcagttgcgtgctgctttgagtagcatggtgacatttggcgccatctgctcccttctgctcaggacatgagccaccctttcccaacagatccacactgtgtatgggtcttgcctgttaatagttgtctcagttctgcaaccgaaagttgtggtattataatgcttatggatttttaaaagcatttgtttaataatggttgtaaagggcaaagatgatgctgacagcttttatatttgtttgtttattgtcaagagaagccataaaatatcatcttacaccgtcacataaggtactgttcaataacatactgtggaaaagagaccagattcatacaatgtctattatgggacattgttctaattgctttttgtagttattagtttcttactatgtctggtttataaaagtaaattttatgagacatagatgtgcgcaagggataaaatctataatatgtatggagttcagtgctctctacagttccaggagccctctggggggccttgggatgtctcctcacacataatgctgtttaaaacattgttcccaattaataaaatgggatatttactgttgaataaaacctataaggcatctcaaaatctttctcatagatctctgaattgacagcagtcgtgaaatacgttcctgggttgatcagggacagaaacaagagctgtacaattagacttcagaaggccagtctctgtttctactccaggtgataatgtaaatggtccatgttagccatgcacaaagtgaggggccatctgctccactatcagtggtctttcaggaattgtacctcttcatttttttttcaatgctgtgtatttaagagtcataagaaggccaattcaaacagactgtattcgtggcccaaatttctggcccttcatttctagctgtctgttgatgatccttttccaatagtatctgtcagcatgtcaaatccatcatgatcaaagccggatccattaacgtctgctccttgccactgggccttcctgctgtatcccgttgccattagtaaccatccctaccctttctccatcttgaagcacaagattcatcttcccactaaccccgccccatccagacggccaccagttctgttattctctgaaacccctcatggtttctcagcctccttggctgtgcttctcctgaaccttctccacacagcccctgtcactctgtcacctgtctgacccccatgccgcttccagcgcacgaatgtcgatgtgtgaccgctcttccatcctttgacttaaagtttgtttattacacgctgggttcctgtgcataaggatccagatgagtcttcagccggtgaaaacaaactctttcatagtacagccatggcctgccttctgttttctgtgaacactcactcgtgttctgcagcctacagagctcttggccctctgttgtcccctttcccatgtgctctttcctgtagcttcgtactcatatattgcttcccactttattatattttgattctgttcttaagtctgccttctccagatcttgtctctctctctatatatatgcaaatatatttataaattgttatatattgcttatatactttatatatgtattgttttatatattgtttttatatgtttatatttattatttatatatagaaacaaaaatgtttgatttatatagtaaactgataataaatagggtgaacaataactagtagtaaaacagggccattatatcaggttgtggcaataaaagctagtcaaaatgcatgaattgtttctctcagaaacttttcacaaaatattttaagtccgaggccgacccgaaggagagtaactgaagccacatctaatgaggtgacttactgtgtacttagtgtcatctgtcttcctgatagaacaaagcactcacagaagcagctgttgtcagggacttcacctaaaacacaagatgtggccacactgagcgcactacatgtgactctccatctacccttgctgcactgtgtaaggaacactggtgtcctgtgtgctgactctgagttttccagatacttcttgagaaaattcttatcaaggcaagaaactggccttgctggtaaaggaaaaaaaaaattacccacagtggaaaagcccttttcctatctaaacacgcattcctcagttttctggctaccgagtcctttcatgatgcagtagtgataggcttaaatttatatcacctctagtttatatccaattgaaaagactcccttactcacttcaaaccctcagaaacaaaaagaagtggggtatgtgaggatccctggtgtagcttcctttcttgctattttttccgggatgagacaacaagacatgtctggtctttccggaaaggctctcctgagagcataggtgcaaccagcatcccaggggttctgccctttcttagaagaagggttgcaggttcctatggctacgtcacgtatgaaaccaatgtggctttcatacaagcaggaagcttccctttctccttctcctttccgaggtcgtgtgtgtgtgtgtgtgtgtgtgtgtgtgtgtgtgtgagagagagagagagagagagagagagagagaggcttgattagtttctcactttaagacagtcctagaaagctggataagcatttagctcacagatcacctgcagttttatgcttgttaaaagaaagcagaagagaagactgggcacagtgtccctcagatgcttgtgttcatggtgtcttctccagctgccttcattcaatacttttctcacggctgggagcaaacaccaggacaggctataacctaaagcttcccgtgaaagacccacttctttttttttttattagatattttcttcacttacatttcaaatgccatcctgaaagtcccctataccctcccccaccctgctcccctacccaccctctcccacttcttggccctggctttcccctgtactggggcatataaagtttgcaagaccaaggggtctctcttcccaatgatggctggctaggccatcttctgatacatatgcagctagagatacgagctctgggggtactggttagttcatattgttccacctatagggttgcagatcccttcagctccttgggtactttctctagctcctccattgggaaccctgtgatccatcctataggtgactgtgagcatccacttctgtatttgccaggcactggcatagtatcataagagacagctataccagggtcctttcagcaaaatcttgctggcatatgcaatagtgtctgggtttggtggctgattatgggatggacccccaggtggggcagtctctagatggtccatcctttcatcttagctccaaactttgtctgtacaactccttccatgggtattttgttccctattctagggaggaataaagtatccatgcgttggtcttccttcttgattttcttgtgtttttggaaattgtatcttggatattctaggtttctgggctaatatccacttatcattgagtgcatatcaagtgacttcttttatgattgtgttaccttactcaggatgatatcctccggatacatccatttgcctaacaatttcataaatttattgtttttaatagctgagtagtactccattatgtaaatgtaccacattttctgtatccattcctctgttgagggacatctgggttctttccagcttctggctattataaacaaggctgctatgaacatagtggagcatgtgttcttcttactggttggaatatcttctgggtatatgcccaggagaggtattgctggatcttctggtagtactatgtccagttttctgaggaaccaccagactgatttccagagtggttgtacaagcttgcaatcccaccagcaatggaggagtgttcctctttctccacatcctagacagcatctgctgtcacctgaattttttatcctagccattctgactggtgtgaggtggaatcttaaggcttctcggcctcctgaaacagtgctaccacctaggaaccaagggttccatacacgagtgtttgggaaatgcctctcacgcaggccatagcacagctttggacagtccaaatgctcatcccttagtcatccctgcctgtcctagatagtgttcctgagttcagttccccttttgtgctcatcaccttggactgtgccagtagaccaccatttcttcagttcgtagtcttttttggtctataggatgtgcgtaccaggagggcagagacattctctgatttgtttctcgcaatgtcccccagattttgaacatgcccccaaacttagtatgaagcctattgtccaaatggatagagatcatggattccctgatctccatttgcaatctgcacacggtcggtcacccatactcaccaagaccctgatcttcaggaatttgttccttcagaggtttctggcatagcctctgatgaaccaggattttgttttctcacatcaagaatttagaatggttctaggacttttttttctttctcactgcaggtgcttctacttaatcctgcacggatcataaagctgtcaggacaatgtactttatattatatatcacttttcttacttccaagatagccttggggggaagaaaagcactttagtcttttactgtaattatagtccagatttagaagccttgccagaatatcattctaccacacttttttatgatgctgaaatattttaaagaaaagttcagttaagagcatactaactaaatatgtctgtacatctctaaaactgctgctctgcagaacacactgataccctctcacccacaaaattaataaaaaaagaaaaattgataccaggaagtactaagttcacagatttgtctaaactgtttttcatggtttattttttatataacagatccttcctaacaacagaggttttttttttcaaaaatattttatggttggggtgtttttggtttttgtattttacctgcatgtatatctgtacaccacatagacctacccgacaccccatgcagtgtccaacctttgaacttccagtccttcctgcctgttgtccactccattagcaagatcaaacaagtaaaaaacgtctctgggtatgtgaagtattaatatgctaatgagcaggtaggatgtgtgttctggagaccatgagagaatttcaagtgcagtgtccatgagtgaccctgagcaagtcagaagatgccataactactgaatggcaaagagtatagtctaatggaggcattcaaggttggatgaatggctgcattgcctatttattcattaatttacattgaacctgcctagatctcatttacatccacatttaaccactaaggaaaaagccctggtttccttctgtctttcctctccattaaaactcagtgtccctgtgaacttttgttgggatcatcgttatttgcatattgttcccaattgcataatgaatgcatattcctgactcatcccaactgcccagtggcctctggcctgtgccagtcactttctccttggaatttctgaagcgagtgttatgcaagtcccctgttgctcactgagccattagtagagactctctcacccagaataggcattactaaatgtgtgatgacgactcagtccaatttcaaaccaaggttgggaccggcagctcactcttaattgcctgagtcatgcagttttgatgtctcagtctttaagttaaggctccagctgggtttgagatccttcctcagcaaggaatactttagctgcaaatgtcaaaaatcgccaggattggttcagagtctttccagtgagctgtgcttaactgatggtccactttgataaatctaatgccatccgctcgtagctggcaggggcttctgcctttcgggtggtcacagaagctaggagtaacaaggcaaagaaacaaagacacaggggctaccttttcatctggatgtgacttctccatgaagtacaggcatgtagcctggcttctggttgtttagaaattgccggttgcaaggccttctagctgcaagggatgcagcaatgtggactaatgggctatttggttcttatccatctcctgtcaagggaggggaggaaggacttgagaatgaccttgggtaacttacacagtatctgctacaaggagtttatgctttcttcccaagggaaacatacatcggattttgttttggaaaacttctaactgaaaatttgatatgccttgctagctagcatgtgtcaccaaggcaactactcccctatctgcaggagatacggcctatagggttctgtcatcactacattgtgtatatactttttgttgctttccttctgtagagtgtgcactcatccacagaaagaggtcattgacagattatcaacagatcatgaaaaagatggagtgatcataacgatagtgtactaagaattacttaaaggttatgaattgtttctggattttccactagatagttttttagacggtgtttgaccaggtaattcagagtgtcatcacagtattgtagaataaaataggaactacattttaagtctatagtcaaaagaagactttttgtgtatgtagatctgaattgatgaagtaatcagtgtagaggataatttgcctcgttcaacctgattcagtgatgccatgacaaaaggtactatagatatgaaaagtcatagccgtgtttttgctttcttttgttataattacctttattgtacttgtaatagggttcttggaagagggaatatgtttgcaaattgcaggccctcaaatggcagttttgctactgagagtttttatgccagatcaacccacaagtatttataagaaaagttgtttgttacattaggaaaatctacttcaagtctttttttttttctgaaaaaggggtgtgcattaacaaagaactcataacacaactctacagctttgcctaatttttaaaaccaaaaatgacctgatagtctaaatcagaacacctacccttaccagccaccctctcctgcaatccaggtttcttctcaccagatcctacaactcctgaattcatctgcttgaacatttgcctatattcattgtttctgtaagtgagtgggacatggttcatgtcagtaaggacaccatttaggaggccgaggcaaaaggttcctaatgatatcaaggtcatcttaggctgctgaccggaaccttctctcaaaccagtataaacaaatgagtaaagaaataggctaagagtgaccttgtgtgtttacttttggaatgggagtgttcttgacttcaccttccttgggctgtcctttgttgacgatttcctggggaccacagaaaacaagcttaccttcttccgtgtttcttcatgttctctgcaagtaacaacaatgatctcagacattgcttttctttggaacacactgacttactcagttggagaactctgaatccaacgaaggggaaaacatctgttcatctcaggttgttttcttgtgttattggtgcattggcgtttgtttgtttgtttgtttgtttgttgtttctgtcttcatggctgtattttctctgtgtctctcactttgattctgggaatctctcacagacgcttctgtcttcctcttcttcccgtacatcggcatgcataggtctgagccccatcttttttcagtcatgctcctctggcctcttattggtcacaacatgttgggaactggcttttggttatttttatcactgctgaagtggaggccagatagtagatcgcattctcgtacccatgaatatcagaacatctctctgccatttcttttctccggtttctatgatagcaggaagaaagaaaaacaaactaaatgtttacaggctgtgaaacaacaaataaaacttctaaaggtcctttattcatttaattgggcaggaggtaccaacacattcaattatcccttacttcgtgacttcaaacccctaccattgtgcccaacagaggaatacatgtggcccccactatcctatcatgcagaatagcttcacagaccaaaggaccctcaatgaactgtgagttcactcctccctgagcctccaccccacagccactgatctttttactccagcctttggccgtacatggaatgtcagagaatgcaaatggcaaaacactttgcttgactttcaaaacaaggaatgaaagctggtgtgtgaatcctgctgcctaaggagactcccaggtggcagcatcatatgcaattatgtcaggttcagcctcgtgggaaatggcgatccaccttcatggtagcctttatcctccagcaaagtacaacctttcactgtgtcactggtgactcactgcacctcctcactgcactcagatactcttaggatggccaggagctcctgtttccttagtatttcttagtatttctcactttaaaacctagagaaagcattggtaatatgtaagctgacggcctttgcagttgggggatgggatgagagtgttctgccatcttatcatctttctgtgactgtttcttgcccggcttgtgaagaaatggctctgcctcacattttcacagacttctccccgcccttctgttttctgttgctgtgctcagctttacacacccatctcacctttcttacatcacagaagaaactaactggcctttcagctggtggcagaaaaacatctttcccgcctgctaatgcttcctgttagccctaaaagctccaattagaagtcgtaagagggacacgttcaagattctcggagaagatgcagcctcattaaaacacaattgtgtgcttctgctttaaatagtgtccaaatagataagtgaattcaggtccgcctaaatttaattccagaaatcaaagccacagcaataagaactggacctgagttctcttagggcaagtaatttaatttctcagccagttgaactattatgcatctcagttcttagttattatgacagtaaattatgccgacagaggcggtgaggggtgatgtgcatataatttcttctttttcctggctaagcacacaccagaatgcagatgtcttaaacagcttttccctcagccaaggcttccgtttggagctttaaaagcagtgtttacgtaataacggaagatggatagacacctcagggaatccagctgtgtatatgcttcaccctacctgacagcccagggctaaccaaatcctggactgtataccagtgatgaacactgtcacaacagtcatggagtgagatcatgggtaattcatggtttatagagaatcctggcctggacttagcttttctccctgccattgcttttgcattaccactgacagtggagaaacaaagggaattgtgactgattcgattggacaaagaggggattccagacacaatcaattcaggaatctaccacccttcactagaaaaacagccttgagattaagtaaaagaccccaagtcaaatctgcgccagctgtaggtttagtttggaaatacgccatcggtgctagatgtgtgcacagagagttttgtgcaggcaatcaagaaatcaattagtttaccctatttatatctaggcagatggaggcttatcctatctgattatccatttctcacctatttcttcatggtcttgatgagaatgtgaaaatcagttatagtctcctacctatcaacacattatgcattagcacttcactaaattattcatcttaataatttcttctgtacattttagtcaaacgtttcagaatatgttgtgtttttcatcgtatttcaccagagttggggaaatgtccccttgaagagcccaacatagttttataggattttttcaagtcctgcatcctgggcttgcacccaagggcctgctatgcatcattcattacagaacctgtacaaagtatccctggagttggaggaaaccacaccggtcccttggtgctacatccatctccttggatttcctttccctttcattttcaggacagcatctcactgctacgctgtcagacactgactgtgagagtctttcaacctctggaagcatgtgagatcacagctgggaccattccagtctctagctcacatgatacagtctatgacactggacgcacactcctttagagctgagctgtgtccttcctcaacacatccagagcatcatggtgtcacagctcatacaacctccagatttccattgcctttcccaatggaaaagcacactccttcttgctggccacactccacttcggggtgatagtttccgtgtgccctgtttgttggtggggacactgacctggccatggcctcttttccactctcttgtgtagtgcttctcatttgacacaactgggccagagagtctcagtctcagctgtttgtcttgtgttggctttttgatgtggtccagcatgtctctgtcctttcccagtaggcaatacagggtaggctctccctgcttttatcttcatccgtgtgctcttggccaagctggcattggcagccagttgctttccgcacaggttccttagtagttccttaaattgtgtcctagacatgtcctttcacgattttatcttgccaattgctacctgacctgtgtgtgttggtacatagatgtttacagccatattatctctcaacagtctacataattttgccttgaccgaagcgtcatataattggagtcagagtatcttctttctgcaaccattaaacgaagagctatgtccacttgtgaaacattttgtggacctcagatagagttcctacttaacagcattttgaccttcctagtgttttttcatcaatcccatactccctcacgcattaccaaagtcccttgattctttttcttcttcactttcctaaactttcattcagccgagtctctcacagctatttttttatctgttcttccagtgaagacaaagtagtagaagtcgccgaagaggaggaagtggctgatgttgaggaagaggaagctgatgatgatgaggatgtggaggatggggacgaggtggaggaggaggccgaggagccctacgaagaggccaccgagagaacaaccagcactgccaccaccaccacaaccaccactgagtccgtggaggaggtggtccgaggtaagccgctgttggattgctatttaactgccctgggataagagatttcaatcagtgcttcccttctccagccccctgccctcacctccctcccaccactcccccaaaatcacaaggcttcttcctcttggtttattgctggtgttggtttggttgctataacaagccgtccagcagtccatttaaactaaaacaaatctcgcttgcatagtcacttctatgccttgtgtatgctgttgaaggagtcctagactatatttatataagaccccacctagccagaaggcatcaaatttgaaaagtgctgaatcatgccctggtggtgggccttcattgttcagcactgcccgttgcatcttggacccctgagactgggaactccttgattggaagaactgtagtttgggtcattcactgtgctggacttatagacaattccaatgaagtttgctcgtgtgaatagctttttattagattttactaattttactaaatctattttctttttgtttactgagtcaaacttttaatatgatttggtaagaatcactttatttcgtgctgtgaagttcaacatgggcaatttgtgttacttgtttaatcgggacgtatgtcggcaccttcttcaaaacaggtgtaattcccatgcctcagcgaatgcccctcccgagaatgttgtaaaccaaagaaatgaagaagacttttcatctccaggaagtgaaagcaaatactttgattatgttaaacaaaccaaatgttatgccaactagtgtgtttgggggttggggaatttaaatgggtatgtgttggttttttttccccacagtaaaatctgcctctagatctagactgagtgaacatgggttgacttcattttagtgtaatgcagatgatgttagctttcgtccacaaatgttaaaaacgcagtaagatttccttcctttttgattatggtgtaatgattacagctcattagagtttaatatgagacactgtccaacccaaggacatcgctaattattattactagccctccctctccctttgctgcattttaaagaactttattgaggtaagattttatatatcataatattaactcattttcaatatataagagagtgactttaataaatttactcagttgtttaatatcacggtaatctcgcccagggccttccagcaccctaatgagatcccttctgcccactcacagacttggtcctcgctcatgcccataaatggctgggctactttggcctccattgagttgcctttctctgaatacttaatccataactgaggttgtacccggcacagcttaatggctgacttgtgtcccttaacagtgttttctgtttttcacttggagtttttggttagtgacgaattgaacacttagatctaatggaagtattctatattgtttaggaagagagtccagtttcaggtagatggtttagttttatcgtttccctacttaagacagcatgtgcaaatagaggtatccttgatctgaatgaaatgctcttcttcaaatgcccaaggcatctttttccaaagaaattttcaaatgtctctggaggccatgactggtagatctggcctaatgaattttttagccctgatttttctcagcaaggaaagaggtgttttttgtttttttgttttgtttttttgttttgttttgttttgtttgtttttggtttttttgtttttgttttttttatttccccactctgggtttcttttcttggagtcacatcacagtgactgataatctgcaatgaagtgaggtcttcagaagtagaggacacttgttggctgcctgtaagtctgaatggcacaggtgaagaccacacacagcctcatgatgaccatgagcgctgagatctaggatgaaatcaaagccaaagaaatgcaaaaccttctactctgtaaattaagaacacagagcctacttcagaacaagcttccaggttggctaacaaaggttcttaagtagatggcatttaagcaaggcaggggaagtgtcgccaggtaaattttgttatgacgcacacacatcacagtcagtcggaaagagcaaacaaaccctgtgctctggtggaagataaggggcatgcttgggagacaggactagttggtactctgtggaaaagaatctggaaaaactgggttgggacagatgctgagaatgatgggaaatggagtgaatttgaccgtcatgagtcacaggggaacacggagtggtgatcttaggcttatattctaatcaagatggaattttctcgagatctgtgatctcgttaactttcaagtcttgttatttttctgaattagttcttccctttctcagtttcacgagtacctttgaattttagatgtttagttttagtatacagttttccatgtaaggtgtaatttttagatcttcagacagaacatataaagacatgaacactatggaatttttctctagaaagcctcaagttcaagtgagaactacaagagatctctaagcaagatgtttataagaaaaatctaaagcaagcactaattttaaagataagcaggagctggggattggcacaggagatagagtacttgctacaaaggtaggaagagcttagttcaaaccctcagagcccgatgtaaaaaggcaagcatggttatgcaagcctgcaacccagagctgaggacacaggaagtttgttgggggatattgttggatgttctgtagaagactctgtgtggagaaaataagacagtgttaaagcaagacatccaacatcctattctggaaaatacagacgaacatacaacacacacatgcacaaacacacacacacacacaaacacacacacacacacacattaatgctataaaaaggtttttttttaaatgtgagcacattcactctatgtaaggcttatggagttcaccaacgacataaattcaggcaaatctttccgagatgttagaggatgctcattaatgatgcagatgtaggattaaggcagacgacccttccctgtgtattcctagtgtagaaggcgactgctaattcttctccttagtaggagccccagcaatggcagagccgatcgcacactttgtaaaaccctccctgcaaagccggcttccgtgcctgggaagcaaacactacctgcagagaacagattagtattgcactcttattatcaacgtcaatgttttcgcctctgaaaggacatgaatgtgatttaccaccattcatagaaagaaaaatcatttcaccatttcaagactccggcaactaagccgagtccttactgggcttcttaagaactcggtcctttcatagcccattggctcctgagaggactaagcagagggaaggaagcagaagatatttttacctgatcatagaacttctaaccccagctgcctgttctgcattactgagttcagagagaaggcaattctttggaggtaagctcgttactgcaaaatccatctggttgctaagctttgctaattaggaagatgttggatatcagtcaaatgcctcaagttgttaccagttaagggaagcaacagtcttagactcttgttctcatttttttcagatcataagtccgagatgtgagggttttcttttctgaagtgtgaatgttgtaggaattggctcagctttggcttttgaacccaattctgcctgtccagaaaaacgttttccttatggttatttattcagtaaatattctttgtgccctgctgctggctaaagtctttgctgctgtagaaagcatagcagggctagcacagacaggcttccacctgctagaagcatccacgttggagttctttagaacttagaagtgctctggctcaccgtttcccttgttctttaaagccatgtcttagtcagggtttctattcctgcacaaacatcatgaccaagaagcaagttggggaggaaagggtttattcagcttacacttccacattgctgttcatcaccaaaggaagtcaggattggaactcaagcaggtcaggaagcaggagctgatgcagaggccatggagggatgtttcttactggcttgattcccccggcttactcagcctgctctcttatagaacccaggacctccagcccagggatggcaccactcacagtgggccctcccagccttgatcactaattgagaaaatgccttacagctggatctcatggaggcatttcctcaagggaggctcctttctctgtgataactccagcttatgtcaagttgacacacaaaaccagccagtataggctgtaattctccttttaagccttatagctgtagtatgcagtagaaaagttatttcccctatttgaagtcagggcaattatgacttagggaaactttaaacatacattagtcatataagtagtaattgatgaagccaggatttgggtccacatgagctaggctatttcagtttcgttaatgcccaaatgatattttcacttttctttctaaatacatactcttctgtttaacttgcacctcctgtaagtgcctgttcatttgctatggacatggatgcatcttttatttctgtgccgtacattcctggaattttctgtttttaaattaaacaatagtaatgatcaggtgtcaatgatcagtaatacatgactagtggtcacaatactatatatatattccagggaccacaagtagcatgttacctattttttaagacaaaggttttcctgggagacactcaaccccacttatttagatgttgtctctggctatgttcacgctataaaagcagaatatagagctgaggagatggataattacaaaggagattatactgtcagaaaagaccaaggtatatactgtttcttaatctcagatattgttcaaagaaagaattctacttactaaaatcaagttgatttcagtgtgtgtatgtgtgtgcgtgcgtgtgtatgcccatgtgtatgcaggtacatatgcatacatgtggatgtgtgtgtagaattcataggacaacctcattcatgcatgtagatatgtgtgtagaactcataggacaacctcattcatgcatgcaaatatgtgtgtaaaaatcataggacaacctcaagtgttgttcctcgggtggtcccaaccaccttttcttgtttctagactttaggcagtgatgggaggcagggcctttcactggccaagaactgatccagtagactaggctacatgaccaacaagtcccacatatgtttggaatggtaagcggtcccgccttgcctggctttttcttaatgtgaatattgaactcgggtcttcatgtttgtgcagcaaagagtttatggactaagccatccccctcccctcagctccatctgtagtatttactggagacatttatcattttatggccttgggccagtcgagtaacctgctttttatttgcctaacataagtgctgacgttgccttgcatgttttaagagtgactttacatgatctatgataagcgcttacctaggaagacttagacttagttgctcaagtacaggttgctcagatttgaatcctacttagccctgcagcctgggaactgcaaaatcctgcacgatgcagcaatgcaagtagtcctgcatcctcgtatgtctctgtaaaactggggttgatatctagccactctgtgagaagcaagtggctcctagtaacccctgggaaccattgagcccagtttctgacagacaggaagtcctcagcctggagcgtgtggtcactgcggttgtagtcatcattccaataccttggtagattcagaacattagacaactagtgtttactaccagtcagacgtattaaaggtaaaccaacagattgacattttaattgcagtgtgatgcatctctgaactgttggtacaacagagctggggtttgtagacagcattctgttaccattaaaatgcagcatgaactgggtctcctgcttaaaatagttttgtgtgtgaatctattcccacatatcaagatatttgcaattaaactttatatctagcggcaaattgaacaagatggtactgaatgtcacgtttcaagatcgactgtttattccttccatccattttatgccccgtgggaggaaattcatcagtaaggggacagagagagagacacggacacaggtgactttttaaacacttgtgtttgtgaagctaaaatctccggtctaaaccctggctggcttatgttagctggctgatcttgtgaagttattgctcctctgtggataattactgagaagcagcagacaagtatcaggaattgacatgaagacatccccaacagtgatgaggcacatttacacactgggcacagcattattctctcggggcccagggatatgaacccaggtagctcaggtctgtccatccagatctgcgtagcctcttttcaccctgtgtggaaaagggcatccgtatcctgtggacgttttgacccactgacagagcatcagaagtaatgcatctaacaagcttcataaataaagccatgttgctctgtagggtataaaagagacgaagcttatgtttctcccccatctccattggtatggctcaataaaggcatgacacaagcagcctggaactcatgggttcttgctttgtctgtcatgctcagctttttcagactccggagaaacagtaaacatggcttgctgtgagtgtgccaaggagctcaaagctctaaagtgtgtttgggggttgagggggtaggaaaaagaacagtagtatgttcgttcttcaagagccagccataggcttttacctctgctctaactaaggcagagaatgcattcacacattcgaaccaaggtgtggcaccccctttaatgtcgggaaaactggtgtcagcactggccatgtaggtgacaggtggcagcctgttattttgtgccctgtggcataacagtcactgattctaagccattccatgcatgctttgcttgggctgaggggtccatgtaactgttgcttaactgtcctaatctggaaagcctactgtagcaattagtgtgcttaagacacaggactggggaatgaggtttacagagacagagagagagagtatacatatatgtggttttcttagttttagtaagaacttcattgacataatttcctatcgacaaagtttagtaaattcacaaagatctgtttgccataagaaaatttttgtgccttaagtaatgattatgtgtctacttaacagtttatatcgtaaaaacaaaaaaataagttccttaaaatgtaatgcaacaaattagagagcaggtaacatgattatgtatgtatacattttcgccttttcaattaatcattaactccagcagagtgttgttgtctcaggtaacaaagctctggttcttcgtggaaatatttagttcccttaatataagtgtccagaactttaaaagtggggtggattgcaaccaaaatatctgtttctgttggttttcagcaatcccgcccttctgaagatccgtctgtgacttccaggcatgtatcagagtagcgtgtctatcattttgtgtttttattaggagaatacggagaattccagaagagatgagactgaataagtctcaatgtgtgtgtgtgtgtgtgtgtgtgtgtgtgtgtgtgtgtgtgtgtgtgtgtgtgtgtttatgtatgctgaaacacaaaagactcattgtatgactttaaacttgatctctctgtgtcttggttgcttgtgctaggatcagcagcctgcaccatccctggtttgacactcctactatgtaagcagtgacatgtggaggaaactcttctctgatcgggtgtttcctcttccaaaggaatccattctccctaatacactgaggtgaaaggcaaaccctggtcatgggacagactttaagtaggaatgatgctgttctcagtttgaatcttaattcttctctgttagagactatggaaggaagccagccactgtggaaaggtgggcatgccctgtcttcctcagacagaaacgtgtttccagaccccagctcactggaagtgttcttttgttctcaaaagtgttgatgccatctcgaatgtcttcccaggaaaacgctgtgaaaagttaggttccaagtttgctttagttcattccttgattttttaaaaatttttttcagcattattttcaaaataacaaaataataataatataatatgaaaataaaagctgtagtgtggaagtcgaagagggccactagaggtcatatttctgagaagtgacgtttttataggtttaaatataagagaactattatctcagtattgattaaggcagaagtgttgtggtgtttttaaaaacagttaattgtatagagtaggaaaaatatgtattggcaatctgtttaaaaacagttcatctgttatctttctgtattttttattctaagactcttctcatttcccacatgaaccaaacgttttccaatttttaccagttcctcccctctcgtcctaaggtgcgactgtgtctctatatttttaatataacacatttcaactacatttaataagttagttgggcatggtggcacacacctgcagtctttgaatttgggaatcagactggaggattgatcataggggtttactgtgtacatgagccacgtcatgtgaccttgcttctctaaacacaggctagaaagccacaccctcccacactcgctacagcctttcaaggtgcttagcatcctttgcagttcttctccaggcacctatggctttcactgagcctacacaggagagaggggcgtggctggtcagagagagagagagagagaggcgtggctggtcatggagcgtactttgatgaaattttagcaccatttcttgccttctgtgttttgaggatttgggcatggagacaggaaatttgaaacttaaggggaaagctttctttttctggtagctttccattcgtgcctgtgttttcctggtgtggcactgtcagatccctactgggctgtgaaaactaattattactgtagtgaggaattttgggagtcataaccactacagcttgaaataccagtcgtgggagttttacctagaaaatagccaaatgctacaatgtatttatcttcccagatacacacaattttttaaagcaaattcttccatctcattcggttagaaaagaaaatatttcccctatgacacaaggtacgccttatccttaccctgttctaggtttaaacgtgttgaaaacatgttgtgtgtccaattaaccacagctgacaggaagtcaaggttcttgaagcatcatagtggtctctgagctcgattgcagcagtctcaggggcactgactggtgtaaaacccattttacagacccatctccttcaggtgctattttataagaaacctttctgcatagggaggtgtgagaatcaggtcaagtgtaattacaatgacagagaactgcacatctcaatacaaagcccagccagcttgaggctacctgctacactgggtctcaatctggtggttgtgacccctttggggtttgaataactctttgacaggggttgcctaagatgattggaaaacacagatatttgcattgcgattcataacagtggcaaagactacaatatgaaatagcaatgaagatgttaatggttgtaaatttaatggtaataattttaatagtaattttaatgttggggggtcaccataacatgaagaactatgctaaaggttgtagctttccattaggaatgcagccttaggaacactgaggaccattgtgctggagacttctataaaaaattcacacacatcgtccttctgagtctatgacttcaataatgtgcacagctgctcgtgtgatttgctgatatttcaacctgtatttggaacatgagatttcatctccagcttgctggcctaatttgcatgattatatttagcacaacatgattactagataataaatatttgatcatttatttcctggtaaagattaattttcttatcgtttttatgactacttgttagcattcacaatgcatgatgaatgtgatttctgctagaagtatgtgattgtagcattggagttaacacgttctttaaaaaaggaaccacttgggctggtgagatggctcagtgagtaagagcacccgactgctcttccgaaggtccgaagttcaaatcccagcaaccacatggtggctcacaaccatcggtaacaagatctgactccctcttctggtgtgtctgaagatagctacagtgtacttacatataataataaataaatctttaaaaaaaaaaaaaaaaggaaccacttttctaatgtgttgttttaaattttgcttcatctatgaaaaccaaacgaatatttacctatagaatatagtttttgttcagataaattaggctcttggaatgttgctatattgcaattgttaaatttgtagcaataacttaattgggatttttaaaaaatagttttttcatgcttattttattaggaatataattcttttgtttgtttgcttgcttgcttgcttgtttcttcttcttgtcgctgatagtttagaacttgctctgtagactagactagccttgagcctgtcaatatagtcctgtctctgtttcccaggtactggaattggcgggtattcaccgccacatcttgatcatggttgttttaaaggacactgacatcagagttttccattattatggttgaatgtagaccacaatttatttgaatgaagtattgatgatcaacacactgtagtacaacttgaatgtctttaccttttaagctttatttcactgttaagttagatagcaaagctgtatttgtctttgttctctacaattagagactaaaattacaaaaacggggttttaaaagaggtacatttatattatgtatgtctctgtattgtgtttaatttagcatgtttcacagaacatggagaaaatcatgctttgggaatgtttttctccgcattctgagaatctgcatctcctaattttatccatcaaaccctagtatcggaaggcgctccatccagtggctgtctgccggatgctaaagggaggggctcacttttgtccagttcttccaggctcacacagacccatcccatcccctctcccacacattatgcatttgccactgtttaattccattacctcacctgtgcccgagttctggctctgttattcagtgagtgggagagactctgaggacacgccccttgtaccagagccgacaaggatggattttgctgacagtctctgttgactgaaggtggtgccagtggatccaaaacttctgttcctcttgtggccacactacaaacccagtgcaggacactgctgtccaatcttggcattgataaaaccgaagaagagactactgaaaagtaatatcacgttaggaacaaacgagggtgctataaagcatgtacagtcccagccctcaaaaggaacaggaggaggcccacagtaggaataccagtggggaatgctggaatcacgtgattcctcctagaaactggaaaagtcagaattgtttcagatgcttgtcacatggagtggattcccatggagttctgtttgaggctctccagggttagaaacccccaaataagagatggagctattgttctccttgcaacaaaaacagacatgtggaaagtctatagagctctaccttctaatagggaggaacctttaaaatgcaagtgagtgggttgctgctttttaaaccaatggggatatggaactgatttggggagacaggggcaagatagactgacaagtaaggtgtgttttaatgtaagataatgtgtggtatatattaataaatttgaatgtgttagctgtatatgttactgtttggagcatgacgggctaagggtcagaaaaaaatacacgaatagataatttcttagagttaccatggttgactgtcagtcactcttgcagatgttacgtacgttttcaggtttagtccgtggacaggctggaaacattaaacataaatgtgattacttatgcatgagtctaggcgatcatttactaagaaaaacagtcagaagttggagagaacgtaaattttggcatcacatcccgagaaatcctttttttttttttttttttttaaacatcagagttgactcaaggttgttttagaagatgccttttttttttaagagaaatttttgatgtgcagagagagagactttttatctttaaattgagaaaacaaccttttcacttctagcccaaatcctgtagctgctactgcatcctacacattaaacaagccgagaatgtcttgttttgtggaagaggtgactctgaagtctgagtgggtcaattcagtccctcaaggaagacttaaagtagctgcttcctccgttcagcccaggtcaccactgggaggatcagggcttaagttgagtaagtatgtatgtgaacagccagaagatgtcttttctcgctaaatgtggttcccctctgattagaggtgtgctctgaacaagccgagaccgggccatgccgcgcaatgatctcccgctggtactttgatgtcactgaagggaagtgtgtcccattcttttacggcggatgtggcggcaacaggaacaactttgacacggaagagtactgcatggcggtgtgtggcagcgtgtgtaagtggatccttcctccagcctggccacctcttgtctttctcgccactggctctgctctttgtaacagatcgagtttccctcttgttcttgggaatgggcccactgttgctaccactaaccacatgcctgtcaatttctctaattaccagaagcctcctccaccacggtatgtccagtcatgagcgtatctctccgtctatctctaataaagcatggccttggatgtattctgtagtagtcatcatagagtcttctttcaactcctaggaacttctgactgcttctctttacacaagggctagagtggcttttgtcttcttcagtccttcctgcagatgcatagacatctgtgtctgtctatgttcttacatgtcttcgtgtttctgcatgtgcacatgggcagtagcctctcactggtagctggcttatggcactgtcttgataagattgctatagagaattcctcttatttcatcatggttttttttttttttaacttcattctgataatgacatttaattgaattgagctcatgtcacctcaggtgctatcatggtgtttcattgctgtgaagagacaccatggccacagcaactcttataaaggacaacatgtaattggggatggattatagttcagaggtttagcccttatcatcatggtgggaaccatgggacacatagttagacatggtgctggacaggcagctgagagttcttcacccggatcggcaggcaacaagaagaagagaggtactgggcctggcttgagcatctgaaacctcaaagcccacccccagtgacagacttctccaacaaggacacacctactccaataaggtcatactttctaataatgccattctgtaggggcctatgtggcccattttcattcaaaccattatactatgggtgcccatgctgttccctgaatgaacctcgagcacatattcttgccaagtttttctttttttctcatgcaattaggtagacgagaaatagggatcgggaccatttaataaaaactcttgccatgcaactgtgaggacctgagttcaagtccccagaatgcacataaaacaaatgtgcagtctgtgcctatctaatgctagcacttgcaaagggggatgggaggcagtggctggagaagcacctgaagactgggaccagctagcctggcctatgtagttgaagtagactgttccaaacaaggtagaaagcttgtgacctgtgactatcacatgggctccgtggcgtgtcacacatgaatgtgtacattcatgtgcacacaaagaaaagaataatgctagcaactttcagtggcacaaggctgaaggaaataacttacagtgtctctcaggaaacatccaactgtctctactgtgggagataatgatgtgaagtcctgatgacttcagtgtaaaatgaagtattccccgcagagagtcagtccccaagaagccatgtctcagatatatggaatatctgcttctattagtagcctttcaagcaaagtccttagttgtatttgtttattcttgatcacaagttggctatatgaattattcaagggtcttagtgacagtgcatgcctttcttgagagattcttgcattttaattcttgaatttgcagggagacatatcccttccctttccctggatatctgggaacattctggcaattttccaaccaaatcccagaaccaagcaaaacaaagacttgctctcttaagacctcacactgtgaggtagctaatatctgtttgggacctagaaaggtcttattggtctcctaggagataactccacttaagtactctgaggaaactagtagtggagaggctctgacttcaattggatgattgtagctcctagttgaagatacccaagctcattttcacctagaggttaattgggttagataactgaaacacaataaaggagtctggtgcctggagcctttggaacaaagggcctttgttacctcggctctaaagggtttagctgctaggtcaggatttcctggcaaagttctcaggtttccccccctttccctaaggtagggttagtttctggaatatcatattctagcgatcaggaagtttgctttatattattagcagagaacaattcaactcaagttttggacactgtcttcttacccaccctagtgtaaacccccctcatctcccttccacttgattactctgtgcagggagtataaaacattatataccttcaccaggggttggagcatgcatacactttatagatggatttgtaaaaatccagtgccttcaacagggtcttatgagagaaggtctgtagtcctgatttcatttttacagagtcgggttacaaggtatcaaggaagcaaaggcacagctgggtaccagactctggtctgattctcagaacctttggaggaataaggcaggggatgggaaggctggagagatgcttcagtcttcttttaaaaaaaaagaaagagaaaatttcaataaaagcaagagaaccagcgttcaggtctccagcacctgttgagcgtggtattgttagcacttagaaggcagggacaggagcatccctggggcttgctaggcagccactgtagccaaccagcaagctccatgttcactgagaaactttgtctcaaacaatatggcgagcaatggttggaaaagatctatctgctctccacacgcatgaatgtgtaaccctgtgcacataagcattacaaacacatacactacgcacagtaatacaacttttaaaagaaggaaagggaagaatagggttgaaggtcaggttagacgggtggatagtgaagaatggaagcctcatcacatatctgagccagacctcagaagcgtccccgtgaacaagtgacatatgcggagctactgctgaggaaggcgcagagagaaatgagggtcattggtgctaatgagggaaaagagacccctaagtcctcctgtagatttcccagtgtcctgtcagtggcagaatgggcagcaatttcacaatactgatctttactggtaacaaatctcacctgcatttccttggttctttgtttaggttttaattttagtttcatgatttccctcccagccctcaattttgtttgattgcttttgagtcctgtgggtgtgtttctgccatcattcccacctttctgttgttggggtttttttttgtttgtttgtttgttttgttttgttttgttttgtttttagttatgttctctcgttttctccatagcaacccaaagtttactcaagactaccagtgaacctcttccccaagatcctgataaacgtatgttgtcactgacttgggggaggggcaaggggaagactatgttgcatgactgaatgtgtccttcccttgcatcatctgcttggcatgggttttgtgtgattattgaccaggaaccttttgatagatactattttcccattgtcttgcgtgtcatttcatccggtttttactaggcaacttcagatgttgggcagagagcatctacttaaaccatttacacttctgaacaaattcctttctgatttgtgttgttctgtgaaataccacacatagagtatttcttgatttggcagaacttttttttttaatttcccgaaagctgtcaacatgccataatttaatgaaatcatatttgatagtacaggtaaccccctccctaaaaatgtaatattgcttattcaagacaattttgtgtgcacatttcaaggttcctgtgttaaatgataactgtgcagcattgggaggtgaaaggtgagccacatagatttcaggactcccctcctccccctcccagagtgcacactggttggtgtgctatcaggtcttccacttagggaacttaatggaatttcctataaaaagacattgcttcaaccatataatatactcttggtcttaacagcgtcttgctttctggttgcccaatcagtctaatttcattttcaaatgtcatatctaacacatccatattcgcttttaaaattcagtctgtatttagaaatggatcccccctctccagggatggtctatattgttggtacttactgaggcttgaagaggaaacccaatttcagttggaaatgagatgattaaaattcgcctttgtcacgattatcctggaggggatggggggatcctaacctcaaaactaataagaaaatgatttttaaaaaatgtagtgtagatgattacatcatcctatactgttattcttcaggggcctccataagatattactgttaattcaaataatgggatgatatttgaaagatgtgggtttttttattgacacaataagcccatgtcctgatattgtgaaattgttcctctaaaaccttaagtctggcaagtgggtggtagaggactagggaaagtctccgagcgtcacacccaaagactaggaaaacatcatttgtgtgtgtgtcgcgttgttcccagggttttcaaagattgcagatctccttctgacacacttgtgtaccttttccttgcatctttggtgcctatgagaaaatccgaggcctaacgctctctgtgcgttgtctgcaggcatcaaacaccagagggccgtgtctgaaacctaagggcactctggctgggctccacaccaaatggctccacactgggttctgacattttctaggttagacagtttccaaggttcagaaagcacattttcaaaaaatataagaaaccacacaaaactggaaaatgctaacatacctccccaacaaggtcacacgtatgaatagtaggcatttctcatcctgtcttgaaaacgatggtaattggttctcttccattttatttcctttcagtatgtaaaaggctgttggttttcactcttcttcattgattagaattaaacattatttgataatttatttttataaagtatacataaggttttccagacagatcctggaggcgtccctttctcctcccatctgcggtgtggtacagaccctaacatccttccatcccggggggatgaggtgatttttgtcagctttatttcttgtctccctacagagactattcaatcacagcaagtgaagggttttgcagtgctagtaccaacatacgggagaaagcatataatttctagttatttatagctgtgtggttgtgctgcctgccttatttatagctaagccacacatttgaattgaaaaagtcatggtcacctggaggtcaaatgcagatcgcagcctcgattctgaggaaatgtgtgcagaatgagaagaggagcaggcagcctgttccactggaaaacccaggcttatgcacggcgtcttcacccacttagagttaattgaatggcatctctttgctcggaggtgattggttctacagatgctctgtctgaagtgctgctagtgggagaataaatgctaagtaagctagaaaaggcccttccactgaactgctttaagactttacatacagagaactgtgcactgggaccgcatcatgaatcatttcctgacaagtcttaatgctctaaccaggcactgctagattttaacttctcccccacaaacaccaacactgaaaagcaccacaattttcaggacacttatttgtcgtgactgctctcccagagacctctgcaccacagggacagcgagaggcctgagactgaagagtggtcttattcctaaccatgggttcctatctctttgaaaaccctttccatctgaggtgaagaacctcctgtgtctcagcagcttcggacgtcagttctgcatctatttgacttaatacacaggcctcacctccaggccctcaatgcagttcttgtaaaatagtaaagttattaggtaaagatttgaccagcttatatttcgaaggtgaggagagcgttgcctgtctgtgtgctatctccatcagacctcatttcaaaagcaggcagataaactccatgatgaagacaaagaacattacaccatttttttttctgatttattttttattttattttattttatttttattatttagtatagaataaagtttattcagggcatggggaggggagacaagagggtagtagaggcagagaaaggcagaaagagtagagaagtagaagagtggaggccggccatgagcacatggagagagggggaagggaatggggagagaggacggaaggggcaaggggaaagagagggaacaagaagaaaagagaacaagagggcaagagctacttatttatttatgtatgtgagtgctctatctgcatttatgcctgcaggatagaagaaggcatcagatcccagtaaaggtggctgtgagtcactgcatgcttgctgggaatccaacccagaacctcagtgagtgagcgctccagggatctaccaggcgctcccacttttccaccatggtgcagtataccacagtaccaagatgtacctctgttccagtctagtattctcttcacccctgacctgactgagagtggaactacgttcatatatagatttgtgggtcacagatgggagatcctgttaaagtataaggatgcctgaagccgcagatgtttatgaccctgttagaccaacttcctagatcccagatgctgttgttctttgactacaagatcagatgtctcagtgtttttttctaatgtattgtaagctacggtggatacagaaggtagaccagcaagctctgttaatcatggtttacccgcatacccctccccacttccccgtttgtttcatcctggtttccattaacctggctatctgtagagatgctggagacccttgcttcttgtttacctctatcttggcattgtgtttctggtcttaggtccatgattacagcatatcagggggagatatggccccatacatggttaaaacaggggaagagatggctttgtccacacattgtgtgatccagtagtcccgaagtagttttttgtatcagaaggttatgatttgcaaacagtagctgactcatgccaacatgaatagggtctaccagtgttaccctcagccattgtccttggctagttttgggctattgttttaaattattcttcatttgttcttctagctgtgaaataatagccatcaatttgttagcacatcatggaatactaataatggaactatgctattctcttagactgccaaactatagtaaaaacaattatttggctaggcatggttggcgcacttctttaaccccagaactcaagaggaagaagctaatggatttctgcaaggctgaggccaagctgggctccagagttacttccaggctagtcagagctatataatgggacctatttcaaaataataataataattattattattgttgtttaaataattcttgcacagatatgtactccttccatcagctacttgataaaggcatggaagtgcatccattttattaaagggattgggcgtgcttttctgtcaggccgtagagtcactatcctatctacacactgctgcaaccacagatagtaaattagtaggtagtcatgactgtgtggttgccatggcagccagcgtcctaggagaggcctctgttggtgatgtacctgctatgcaagcatgaggacctgaatttgaaaatttgaacccccagcattcgaatgcggggactgcaacacaggaggagtctggaaccctggtgctagggtagaatggtgaagccagactagccaatgggcttgctccaagttagtgaaagacctgcctttaaaacaaacaaaaacaaaaacaaacaagcaggtaaataaaagagggagtggccgaggaaggcaccttacagtggcttctagcctttgcatacatctacataaaatggaaagcagctagcagcaacatgtctactttaatacacagagaggttacttttattagcccagagtgtgagaatgctaccactatgcctcttgagagactcggcaggataatgtaagcaggccacattcagtaatttacttacaggatcagagatgtggtcggaaggattaaatctcagcatatgagtgaattgggaaaggttgctctggaaggctgtggtaaatttacattcgctgtatctttaaggctttaagaagttaaggatccatcagcgctcactatcagagtttttgtgatacgactggtagtgaagactggcgttctgaactcatctgttaaatattgagtagttatgactgttcatgtctttgtgagccactgctaatgaagtcaaggaagcttccagcaaactaagaagaaacaacaccctacggctaagcgagtctgacttccagttactattactctcattttatgtctttctgcctggtggttgttcgtattcaggctaaagatagcatttaagtgcagggaatatagctatgaataaaaattatgctaacattcattcttctacattcatcgcacatatctgataaaaaaaaatgtcccatgtcagtacaagttcatagacataaaaaagaaatgtagcttgactggtgaagagtaaacagagcgtagattacatttttattgccttctgtccacgtaggacattcatagtgttctccagcaactgtgttcgaactggccgtaaaagaagagaggctcaagaacacacctctttaaaatccagtgtgctgttgaaagatcactcgcttctattttcctgttcatccaactcagacttggtaggggtggccgctatttaggttttgagtggaatgtactaagagttttagctagtttgaaattagagagatgaaggaaactttatattaaaaaaatgttttaagtggagatggcagtttgaaagccttgtcacgtggagattaaaatttcctataaagtccttctttataggtttacagttcactcatacataaattactcacgctgtcatagcccataactcgtagccatttcaagggaccgcattactagctctcaatcaaatagaattttcaatgataaggcagtgagttacataagtcttcactgttatctttgcttgccattgttgtatagataagctgcattctgccaggggtgggggatatatcaaatagatgctatccgtggggaattttgtctaggaatcactcccttgtgttgtagtttagatggtcaagggcattacacctgacccccaccacacacacacacacacacacacacacacacacacacacacacacactaacacacatacccagcatacacaaaacaaaataagtaaatctaaaactaatattaaaagaaatggtgtcaccttgcaaattgaggagtcaaatggatatgaaaactgtagggatttttttttaatatcttaattgtcggtgtgaggatcgactggagcccagtcagtcctcagtctccttatctatgcattcaagcaaccatgagtcaaaaatgaatgcctctgtactgagcatatacaagcttttttttctcgtttctcaaacaatacaggaagaaaaaccactccctttaatgtttgcattatcttcagtaatataaacagtctgaaaaaggacagtgtagacattagatactccaaactatatacaaatatacaaaagggaggtgggcaaactggagtttgctctctatagcgaaccctggaaccaaccgcctctgcacacacccaggcacagttagcctgcagggagctgaaatcacagtgagggaaattggtgtatgaagagtcgggctcgatcatgcctgtctgtgaaccctctgagctgcatagtgacttcagccactcccaggaacctcagtgggtttcacttttttttctttttttttttaatgatgtttttttattagatattttcttcatttacatttcaaatgctatcccggaagtcccctataccctccccctgccctgctcccctacccacccactcctacttcctggccctggcattcccctgtactggggcatatgatcttcacaagatcaaaggcctctcttcccagtgatggccaactaggccatcttctgctacatatgcagttagagacatgagctctggggattactgattagttcatattgttgttcctcctatagggtttcataccccttcagctcctagggtactttctctagctcctccattgggggtcctgtgttcccatccaatagctgactgtgagcatccagtaagttcctcacgtagtaaggcctttcccaggggacagcaactacagaaaatggtgtcgtgttctcaggatagtgttttttgtgagagaccatgcatcatgaagactcagaaatccgaagtaagcctgttccccaccaaccagaaaatagacgtccagtggatcttaagaagacctaagactgtacagcgggtactgtgaccagcactggtgaaatggactctcacatgaaacttactctcataatattcatcttcctgggctttaggtttaggtagcgtagttttattatgagaaaacagacacacccgtgtcccttcgtgtatgtgaccagcagaggagggagactgcagaagacgtgtgtgtgtgtgtgtgtgtgtgtgtgtgtgttagcgctcgcaggagcacgcatacacatatacatatacatttatataaagaattctactctgaggaatttacttctgtgatgtttgtggatactggtaagtacacgattgactccaagccatgggaatcagaatgttccctgtccatgggcaaagaccagtgtctcagacaagaatccaaaagcacacatacctcctttggcctttttgttaggttcaagctcttggagaagcgcctgaagagatcttcagatccagtagccaatcttatacagaaacacccttgcatgcctacaccaaaatgacgattgactctggcacgctgtaactcattcaaattggcacatgaaatgagctagcatagcgctataccttcatgaagcagagtaaatggtaataacaccatgtgttcatttccatgttcctgtaagaaatctatttgaaataaccctgatacccgtaaacataccccacttgctcgtatcctgattattattttattcttatttttgcaggcctacattttcacttagcccaatcaaggcaggttttgctaaggggaaccataatcagatagtacttacagcagattctgtctgtgcctgtgcgttcccaccgtatggaacagaaagtgcaggttgcctggtcacctccgcctgttgctattctatttactagtgtttactgtagcttctcattttcactctgccagtaagagggaaaaaatggttaggtccatgggaagcaagttttgataaggcggttaggaaacacgtgtgtattgatttgcttgaggttgtgcaaagcaaatatatttgtctttggtatcttttctgttacagacagtacttaaaattgcagatcatttttcagtcattcaggataagaaaccatatattttatttacgtccatgttctgtgtggactatatataagttgaatttttctggggtttgtttgtttgtttgtttgtttgttttctggaaaatgtgttgcttttcctgtaggtgacattgcatagtcctgtgttctaacttattttcagtgaattagaagtaaatatatctgatttttccccaaggttagcataaaagatttctgtaggacataatggtaggcaataaaggcaccggcgtgcgtggagttaccctgtgtgactaacacttaattgtaggatgcaaggcatgttatcaccactagataaaaatcctgggatgcagagtgctcgggtcacttgccctgggtaccagctggtgtaaaaacattgttcacacctagctgggcctaatttccaagtcctgagtggaccttccttccctctcgccattgggcaagtgttcccttttttatcagctagatgaggacagttgtttgaggttccaagaataagcctttgcctccctccttctgctcgaaagccacacctgggcagacatctcggctgctgttaggtttttgaaaagttatgattaaccagtgaccacagaaaaaggaaagacatcagaatgcatgcctctcgtgtttattgaaacgcactctggtttctgttaacatggtcaaacctttgattctaatgccagtcattttcttaaatatatagacaaggtactatctccatgtgacctagctgtgacttctcatctatttgccattggagatactgcatcccaagcctctttactccaagaatttgatgaacagtgtgaagagaatatgcgaaacagtggttgatattgttgaatgaacattgaaagtgatttgagaaggatgatatcatttcctgataagggggaaaccttttaaaaactgtctctttcctctctgtctttcttgactcgcttaaatacttccaattcttgcaaaccactactcgttcgtgagttagaatattcttgttttatagttcagtcttcggttttcggagcatccccgttgccaggtaacatcacagtgagtgtggcaattcagatactgcctggcagtattgaattgaaagagaaatcactgtctatttgacgaaccttgcgatgaattacagactgttgccaagtgtgtgaaggctgaatgtccttgcgtggtttcgaaactgcacttgttgatgtttatgtgacttcctgtggtgttctagctctctcatgaaaggtagcgtcgtaattaggctgtctaaaacacaatgtgcggaattcccatctcgccgagatgcctcgattttgcgatcgccttcttctcagattccatttgtgtctgcgggactttacaatgatgctggtgataccattagctattctgcagattacaaaatagccaagccgagcatgaggatttgatgaaacatggccatattaagcagtggatgctggaggaatgcctgtctgggaaaggcatttttaatgctatagcttttaaatgtgcttttcttgctatgttctacagaggtgaaacttgctcctgccatggtaaaatgtctctgggtgcttctttcggctgcattggcatctactgtgtgctcctctttcacacgatttctctgtcctgggaaatgactggctttcttacaaaggttgggcaccctgtgtctcttctcaacttgcctcccatctcctttctagttcccacgacagcagccagcacccccgacgccgtcgacaagtacctggagacacccggggacgagaacgagcatgcccatttccagaaagccaaagagaggctggaagccaagcaccgagagagaatgtcccaggtagggaggaatcttccatcctctgttgttttgttatatagggaaatctgcgctcgcctctgcctcagctgggtagacataaagtttaatttaaatgtttgctgcaaggccacagattccccccacatctatccctgtgcacggtcacatcaagtaaaggcaagtacaagaggattttgaagcacaggtccaactctctgcgaaagagaggaattctgtgaagatggtgaggtgagggctgttaattgatacattgtaggaaactttatcttgtgtgtgagtctcatgataggctgtgtactttaaatgtgcgttgtaagatatacttaaagaataaaaaggagtagttcaaatcagtaaactagttcctattgcccactaagctcgaggacctgagtttgattcccagaacacacatttaaaaagccagaccttgtggcctctgtttttaatccagggctgtgggggcagaagacaggcagcctgtctaatctgtctggagaggtccagccccatgacgtaagccgtttcccaggaagtgtgaggtactagaggaagaacaccgacacctttaagctatgccttattccttgggccaaatcctagctaacttctttatcaggctttgggttccaggctccaaccctgcaacaggcactattgctttgtgaaatctccccatgccatagaactactgcccagctgagccaaccaaactagttattcctaagctggcttacctcaagtctttactcctgcccctaaatacattctaaggtgttgctcagtcctcccgtctatcctcccgtcagtcctcccatcagttctctgcctgagattggccctggccctgtgtccctgtaaatcattgagtcttcttcatagaactcatctcctgggctgttggcatcccaaacaacaagaaaaccctcattttaagcagaactaacgatgtatctcaaaaagcaggacaaggttgctatttcttcaaagacgactagcaataaaagatgactagctataacacttggccctactctgcagttgtaaccctgagagaaaaggttttacaactacactgaaccacaataatcctggccatgaactatcacttacatcctaccagttggccatgagctatcattcgaatcctaccagttgcccatggggaaagcctgaaagccagttgagctagaaagccaactgaatggaacaggcaactaaaagcaatcctctggaaaactagaacttttcacatttttttttcattagaaaagtcatttaggccaggcagtggtagcctttaatcccagcacttgggaggcagagacaggcagatttctgagttcaaggccaacctggtctacagagtgagtttcaagacagccagggctacacagagaaaccctgtctcgaaagaaagaaaaaaaaaaaaaaaagaaacaagaaaagtcatttaggaaggtgtggaattgggaattactacaattccttcctttttagactcaagactgatctcattttctgaagctttcagaggctgccctgggcacataatggggcagaaggccagaggaagtgtaataaacactgagcgctcccgtgatgtttccagcccctgccagggcaccctgatgccagccttgcctccagctggaagctcctcccctctccggctcctctcctctctggcctcactttgctcttgacattggcttactttagaagtgcctttcttcttcttcttcttcttcttcttcttcttcttcttcttcttcttcttcccacccacaaatctcagcagatccgctgctgcacatcttgcttgactcagggcaagtggttactcgaaccttttatttgattctaaagatttatataatagtttacttattggtggtttctatatcatatgttctactacactctaattccttttaaatcatacaaaattatataaggcataccaactttatatttcctccttaaatccatgtgaatcattttttaaaatattttcactttctccaagatatttttatgtaattaagaaaattagtttcaagtagtgtgttagcttctgacatgatatgttgtggaaataagaacactggtgagcatctatttaatccagggcttagttcatagatttccgggagactttctccatcttcacatcccagatcagggactacttagctgtagtcattcctagagcagagaatgcacctggtagtccccagtgttacagcgttagctgccatctctcaccatagtctctgctgctcaattctagggactttttgactttgaacttgtctgtctcttaaatctctacttagtaatcgtcattttctctgcatgacatagccaggcctctaaagaactgtaaatcctgatagaattggtgcctctctgcacacagtgaaaaactgctggacagggacccacagtgcagccctgaagttcagattcagagaacttcaggttttcaaattcggagccttccaacttgacttttgttgtagctttcaattagttttctgggttagcccccccaaataatggacctcatctctttccactgcaggggcagggggttagggaagatgatatttgtattgatgttgatggcctggtgatctgaagatcttggttacagtgtgactggcatgtgtcagatgcagataagcacacatgcaaaacccaagcgcttcatcactgtattagtgacttcttggtatgccaagcaacctgagaagagcaacctaagaaaggaagcctttgtgtgggtgtagaattccagggtacagtccagagtgacacagtgagcatggtgtgaggcaggagcttgaggcagcagcaggtcacatggcacctgcagtcaggcagcagagtgcatggcctgctctctcctttgcctcctgtccagaaaccccagccacagcccagtgcttcttaaatttagggtgagtctccccacatcaactaacctaatccagaaaatccctgcccctgacatttccagagacttggttccctaaatcccatcaggctggcgagcaagatcattggtcacacttacttctatatctagtccatttagtgtgcatgcagaatgaagtccttcaaaacaaaaacttgcccgatgctgagttttttaatatattcagtggcatcttagggacagctactggtactgacccttgacttgcctgtagatagatctgcagcagcacactgggccaggaggatagtaggctcatcatcactcctcgtccattggttactctcacagctttcttaaacaggtctgtagagtaagattactgagtacagagcctgctgtaatcaggcatcaattaaaccagacagattttgtaaagcactttacccagtaatattatctattaccagtgcaccctagtaaaagccactggttaagggggtaaatcttctgcctacagcgtgtctgtaagtagtccttcagtgacgacataggccatggatgtgtgagagtagaagatgtttgctaaattattctgaaaagtcaacattcaagttcatttatatagtaatgcatattttcaatacattacctaggtaaatcttaattatttcatggatctgcaattccaagagggtgatccaggttccgaatgtctaagataagatgatagcaaagatacataatgcaggggaatcggttttcatgccccagtaagacatttagtttctatctcaaactaattttgagatgtcttgcctgaggaattctccttagaacatcgccactcgggaacgttcccttccatacaggaaattgaaacatttttcttcccaggctcatctataaagcgaagcatctcttcaatatcttttcgtccaacgctgccctttattagctaatagaaatactcaagtacctggaacagtttgtacattttccatgtatcttgttctcaagaaactaatttaaaaaaaaaaaatccaactcacgtgctgatcggataagaccttataagcctggttttcctcacagattcgggagatggattaaaaagtccacgaggacctactctgtaatcaactttgtatattgcttcatcttcctccattaggcttacattacagcaggctggcctgcttcctcaactagtgtcttacctttcaccacattcaggagattataatgcatactttctggggctttctgggtggatttggaataatccccttgctactcatgacttagttactgaacaggaagagtccactcttcatttgtgcaaggaatagactttggcattgtattcctggtttacacatacacattcccaaaacataccacttggaatgctttgacttgatgtcgtaaaaggttaaaatcaatgtcttagtttattgatgggagacttcgctcagatggcatacgccttttatgggtaatcagtgtttactcacgtcaagtaaaatgactttccgacagttctcaaggaaaatggaaagatgaaccaaccttatttcgggagactgcaatacatgtaggcatttatattcaccataccgctggcataaattatttatattcttgtaggacaaatattagtcacattgggaggggcatgtgatgtttttttaataggaaacatattgtcgtataagccactgtgttaaatctgtatttgaaaggacaatgggggattttcatattgccttatgtcctctttataggtcatgagagaatgggaagaggcagagcgtcaagccaagaacttgcccaaagctgacaagaaggccgttatccaggtaacaccccggtcccacctacaccagacagaacatgccactctcagccatcaggacctccaggaatctgctggaaacccctgttttatatattttcatgaccttcacttgttcttcacttcttgtcttagtaataagttgcttcccttacattttctccaactatttaaaattagaactaatcaccccaaatatattctatggcttgcaatcttctttccattaatgatacatcttttgagagactgaagttttcagctcctccagtaaccttggaaaatttaagtgagattaggaatttaggactaaacccagtctacacatgacctcgtacaaacagagagaaactatctttgcactaatcgttatgttaagaaacaaatatgtttgtgtgtgtttttatcatatcagcatttccaggagaaagtggaatctctggaacaggaagcagccaatgagagacagcagcttgtagagacacacatggccagagttgaagccatgctcaatgaccgccgccgcctggccctcgagaattacatcactgcactgcaggcggtgcccccaagggtaagtcatattgatttgtcacttcaggtcacagcatcaatgatggtgtccagacagtggagactggaggccgcagggaagaagctaggagaaatgccacaagcactttatttgtagatgtgacttaggtacattgtatcctaaagacatggggtaatagaccagtgttggccctccctctcttaactcttttggcagttacctttatactgatttccatgctgcattcttatttttctttaagccatcattttttaaaatcttttttatctaatgaggaactattatacttttttgcctaatatagtcatgagttttcatagtcatattctctgttcacatttaccatgtatcatttttcttcttgggcatcctttatgttttcaagtgcagatgaaatgaagtttgaattctttgggttacaatgtgtataagctagtgatttatttatgcctgaaaaacaccttaactttaccattggttttaaaagatatttttgctgggtatagaattatcagtcgaagtgattttcttttactactttaatgatgtttgctgttttcaacagaccattcttatcacctctacagataatcttttgtttgatctggctgtgctagaggtttttctcttttcacagtagctattttatccatgtaaaacgatggaattccatctgtccttagtctcttatgaccatcccttcatctcatacttaagattatgtttgatattttcgtgcataaatttttattggctatcataaactatgaaatgttgttggtgctaggtacttttgtataactatgaatatattcagactttgatttgaaatctagctagttttcctagaagcagcttcaccctttcgcattttgctctttttagatatgttaggtggagtgactcttcttgtaacttgttatttccattttcaaatcaggatccttaatagtctaccatgaactctgagtttcaaattggattgacaagaaccaggcagtcatgtgtctgtgggacttcaggcactattacctctaatcttctgggtaccttttacctctagcctctgtttcttataccagcaggcactgaatagtcctcagctacagtcagttagtaggataacctgcagatctcttatagagcacctgtcctgtaaagtctagccacctgggtttccaatgctctttccttcttggggtccactgcctgagagccctaccttgtacagtcagggaagctcagggaccatggttgctgacagttgtaggacctcaccttgtgtatctcctcttcctctctggtccatggtccgtactctgcagaaactgttcctgttatgtagtccatctattccttttctctggcaggagggtgaaattttggtcttcttagcagatcttgaccagaagtggagatttgtccacattatgtaagggaacccaaactccacccacccacttgtgctgatttccctcaccacactgatagtcctttctcagttaaggagctcctggcattcctccgggtatcgagaggacactggttcttttgtactgatgacatcactgtgatctcggaggatggggtggctggttcagggtgataccagtagtcatggacagagaaagctgagagtcagttgcctgctgcagtgtctcttctctgggtcacacttcctccctgaacaaacagcttctgacaataagatgtctatattagcattttgttttctgtgagcaatctctgtctttcccaggcagtacttagtgaaatcctgcttatatctctttgcagatgacaaggttctgggttactctttctttagagagcatgctttggtgaggagagttgtgggggtcatttgtccaggcaagagctgctaggtagatttttaagccgcaggcctgagtcttggggcactgactcctgtgcataaagttaccgaccttgagttatttaaatttggactcagccactgcagatagctctgtatttttgaaaggtgttagaaaactctctcttcccgattgcctttgtgcaaatctctaaaaagatataaatcaagagttttcattaaatcttgtaattcgatctacaaactgtgtttggatatgctgcttataacaaccacagagccataacaggtgatgagaaatatgacttaaatgtgcgctgactatttgaacacaaaattaaaagtcaaaaggtttttttctcttttaaaacagtttaatcttattctaaatgtttgccaagcttcatagacagatcttcctcaagaccagtgagaaatacgtgaccaggggcatatgtgtcctagttttaattaattcaaacagaaaattaaggaataagcttggaagctttcctgtttctcaaaatgtattccttaacatgttccctccagagaggagctgccctccggcacttccttctgggcacgtcttcacgggcagctgtccgcacctgcagtgctgggatgctctgtggaccattcctggggtgctaatatctgcttttttcttttatctttgaaagtgaaaaaattactatgaaattacaagtgtttagatacttaaaaacattttattgcacacaaatgaaaagtgattgttaccagagtttgccctagagagcagggagttggtaagatggcctctctctctttctctttctctctctctctttctctctctctctctctcgctctctctctctctctctctctctctctctctctctctctctctctctcacacacacacacacacaccactcttaaaaccatttccaggggtacatttgcttgtttaaatttaacatgcattctcatcgagtaataataataagtgtcagaataagagtgacttgaaataaaatataaaatataatcagttcagttgcagagaaagttatgataaggagaatttgtaagctaactagtatggaaatataaagtttctgatatgtaacttttttctttttttaaatgattttggctgactattaatattagtggtagtaaccaagctgtgagaatgattagtggtgtggatgaggggtctgagggaaacataattgagaaatttaggccattttcgtcgtttttgtgataacagtggtaggctaaggagacttactaagaagctataagaggttacgtttgttcagggtatttttttggatgattgtgataatcaagttaatgggagaagtattagtgatggtaaaataatttttagcattgtagaaggttagggttttgtacatagtctgttccatacaaactcatcagttataactggattctaagaagtcttactttagttttattatataagtgtttttaattaaaaagaaaaaaaaaacagaaaagaactttccgttgtttcacaacagtgtaggcgttggaaaggagggaatgtagtttaagcagcctaggttcattcaaccttggattgttgcttcattagagagcgtttgaagaaagagcagaggatctcaaatgcgaatatgcaaaattaaaacagattgttgtaagtcaccctgaaaaaagtcaagaatatgtcacaggtggcatttgttggatggccagacctcttggcaaacctttcccggggtctgtgttgctttaaaacatcttttgttgactaattcatgcttactctgtaggctctgccttctgggttgtgttattaagcctgtttatccccggagagcttcggtctgtttggtttgacaaaacaaggcttaaagatgcagaagtccatatcagacctggcctttcagtgctgtggggttggagggggttagctctgtccccagtgtctgtacagctaacatttagctgaaggcatgggcttcatcgcagagctgtgggcaagggctaaatctcagtctaaaccgaatgtcattgacaaaggtcgctggtttgtgggagaggactgcaatcagtctgttttccaaaggttctggtgttatataaagacctgtgtttaatggccaagatagccatttaatctgtaactagggacaagttacttaacaaaggaattcttcctccccagtctgcaaatcggggttaaattttcaacattgttgaaacagcaactagcgtgtttctagcgttgactggccataattcaaaaccagaaggattcactgaaggttgagacaggactgtagagagtacaaagatgtcttccttcccaaggggtctgcgaggtggtatggaacacatggaggctttggtgactgtccagttgggaaggtttgcttcttagttaaagaggagccaatgggcgatgacgtatcggaactccttgcatgtgcgacatgtctgctctagcagtgtgaaccctgcacaaaagacagattatgcaaaacctttccatgtaacacatcattattatctgaacagaaagaagcctccaagaataatctattgccattttctctactcagtggaatttgtgtttgacctacctagatagttttctaaagaaaaagattatagatacattttatatcaggctttaaattttttcactcaatcactaaacttaactgcaaaagaaaaccttattttctaaaatttgcaatgtaagtttccccaatcggttttgatttgtttccttggtttatttttgtttgcgttcatgttcctggggtctccttctggatttcttctcctgtgacattgagaatatgtatacaaggttgatggcaaaatcgggaatcaaactcagtaggagacagcacaaggtgtagctctctcaagtgtgtctttaaaccaccacacagttgtttcatacagttcatgtcatatgctgaatactttttgtactctaagattaagactgcaaaaatctgtggccttataaaaacaggagaaagttactttttttcctgcagagctaaagttcaaggtttcagaagccattagcatgcaatttaatgtttcagaaagggtttttatactatttaaacagggacaggtcatggtttccttccattttgtggacaccagcctggtatcaacatgttataaagacaatggatagatatcttttggaattagtgaaatgagcctcattaagagaaaaattggatatatctggactctgttaggtattttctgggacgattgaccacttcaaacaccttcttaaatggatggggatactgagtaaatacaccaagtgggtttggaatttcagtgtggtctatgaacattgggagactgtttttctcatctgagagatattcacttgcatgaataagatacaaaggatagtttacaggccagaaacactgctgaaattatacttggctctgagtcacgcatcagtttaattaacagtaaattattagcagctacattgagccaggaactatgctgggaggcaggaataggccatgcctttgttcctatctcagaatgtgtgcattctgctttgccgtgagttcttgtcttctgtgctctcattgtggacgtcatctaatccgtttccttactgcgtatccctcatctttccagaaattaatttttaaatgcctcttttaaaaggcagtgtgatcccaaggtgaaggaggtgacaattgaaagggccacatcagctgcagagagaatgcagttacgggacaaagatgcacacagaaacaatgaagatgataataagggggctgggtataattggtcccaatggggcagatctgtttctttattcttaaccatgagttttagatcccacccattgccagtataaccaaattgcagtattaatacttaactgaaataagaatttccaagtaaaatacacatgaacacatacatgtacacacatacagcacatacattgcacacacaaacaatatgcacaaacacacatacatgtctgtatatgtgtgtatatagagagatgcatatagatgtgtgtgtgtgtataaatatgtgtgtatatatatatgtgtgtgtgtgtgtgtgtcactagttagagaaaatttcaagacttaatgttaatgaatattaaattatttattatcaacatatttataatgagccactgaatttttgcttgttctgtgaacaattccattttgaatgtgagtaacatcaggctaacagttattaacaacaattactttaaggcaatttacttgtgagctctctatatagacacagtagagataccaggcattctttttttctaccattcttaagtggacattttttcttttttttaattagaatttaccaaattcatctttgtcccggcataatcaaatgaagatccctagacaacgatggttgctcattactcgacaatggattatatagctctagaaataactatcgtccaccttggagaattgtggctgaaagttgtaaagagggctgtccctctttacatttcatttcttttcttttcttttcttttttgaaggaaatgcgcatgaatcatatgccaaagccaagccgttttctttgtaacaaatgaaaacataataatgtggggaaatgctgcttgttttttaattctttatctacacacactgtctgtcctctatgaggtccggacacacaccattttaagtggtttgtctgcttgttctccaacgtagagattgatctatctaactttttaactttctaaacacgatccttgcaaattgccagctcagagcaaccaagcagaagccagcagctaggagcatcttacggtcttcagagttatctgatgtcagcaggctttgctcatgggggtctccagactcacaggatgatgaggtcagagctcattctgagcccccagggctcacggcgcatacaggtctagggctgggggatcctcgaggcctgctgtgctattgctctgtatcaggctctgggggattttcagggaaagttaggaatatctttccaaaacacacaaagaagtagtggtgttaagcgagataagagcttgaaaccatgtgaacacattctttctttaattatcaccaggcttattagaagataaggatgaattcagaaggcagacccatgaatatcataaaagcccaacttgtacctaataccttgaatcacttttcagtaatcttctaatgagattgacaggggacgttcctatcttctatttctcctttctgcttcagacctttagcaaagtacagcctcctgccaagagcctaggaccagaaatgagatacagtaatctaaatccagatcttctcctctgttaaaaagaactgcagtcagagtgctccacaaattcagtcctgttatctgccctggccacagtttcatttttgcacaattttagtttcttatggtcatcgctgtctcagaatattaaatggaaaattccaagtgccagccataagtttttaatagcttttatttcaccatattgctgttgttttattggggagtgttggtgttttactgactaatttataaatcagtcttcatcatagacatgtgtgtatagtaccaagcacagtcaatgtacaatcggtacctgtccctgagtttacagaactaggaattcagatgagaactcccagaacagtttttcactctccagttgcatcattgtcaagcctatctgcgccttgatagaaatctatcatgttaaattctaagatgggctcacatagtggccaagggtacagagctatggaggcagacagcttttgggggaacactaagtgtctatgccacctggacttgtgtgtcccttacatcatcccttcaggccaagcattaacatccaactagtcaactgacgaaactttttcatcctgaaattcctactccccttctctctctctctctctctctctctctctctctctctctctctctctctctctctctctcccccacccccctggggacggtttatgtccattgtgtatggctctgtttgtattctaaggcacaggaacgtggcctgtaccccgcatatttcaagtacagagcaccaatgccgggttgggcaccatggatcggagctcctgatggagctcctgatagacaggaagtgagatctaatctggacctgtggctgtcactttgaagagagggatctagcataataacggagtatactgaatgcaactactgggttttgaacagcaattcaaggtagaacagagaaagggcaccaaattccacttagaattgccaggagaatgcctcaaagttatatatatgcttaataaataaatatatatgtgtatatatatatatatatatatatatatatatatatatatatatatacaaattataatacacagtgtacattttggggccgtgcacaaaacatgctaatttgatatatatcacattaccatgttttatatatatatgtgtgtgtgtgtgtgtgtgtgtcactatatataaccttgaagcattatataatataatatatataataatatatgataataatatactataaattatatatagtataataaaaacactgtaattcaccctcctatttactccacatatacactcacatgtgcaaacatgtacatagcacatatactggttcatatatgcatatacgcatgcatatgtacttaacatacatagtttctggtaataagttccataccatccaactgtttctctaggtgttgaacacacattatttaatagctgtatttgtctaaacattcctggcatgtcttcgtgaaggatgtatacccttgtgcatcatcgtctgaaatcctaggcaggataccaacagcagcagaattgctcgagacaaaggaaacttaaatcctttttaaaaaatgtcttcatgtaaaacctgaataaattgaagtagaaccagttagaataaaaacacacccaagaagcacctaagaaaaaacttaattgtttctgggagttttagcatctgattgtttgaaaagagcttaattcaatttcaaagtaacataactacagttcaatgagggcctttgttctggggaaagataatgtttcatggggcttatcaggcattccttgcccgacagttgaagagtagttagattgtctgttattttcttattttgattattgcaccactgtaagttactaatgaaaggattatttgggaagcactaattctggtcttggggctgtgcacaaacatggtaatgtaatctcatgaacactccatgaatatttctgtggttaaatagaaggatcttactgaaaactgagaaatccaaagcttattctccctctacagcagaaagcagctatttagaaagagcgtgctgatttaggacagtgtcagaaatactaaacacgcatataattcgtaaagaggaaaaacaggctgggtatccatttatgaagaattgggagaattcccttgcagtgcacacatcatgggacccttgaactcaatgctagtggaagaagtgatgttttgctcacacttgaaacccatgttcttgcggttttcctcacagcctcatcatgtgttcaacatgctgaagaagtacgtccgtgcggagcagaaagacagacagcacaccctaaagcattttgaacatgtgcgcatggtggaccccaagaaagctgctcagatccggtcccaggtaagccctgagtgggggaaccttctgcagcttacagtccagttgttgcttcctcagtttgttgggaagataattacctccctctagagcacctatggtgagggtgttgtatctctttgtcaagagttctttaatatctgaaactctaaaagctaatcttcagaacacacagttctacaaggcttaacatgtggaggcagaaggatggatagttcaaggccagctcggctacttgagagagatgctgtctcaaagaggtgagaagcagagagatgactcaccagttaagagtgcttgctcttcttgctgaggacctgaagttagtgcccagcccccacatttcaccaccacttaaaactctaggttcaggggatatgacactatcttctggcttcctctggttcctgcacaaatatctgagtgcacacaaacacacatacatacacacatacataaataagctgaatcttctacaaaaggaagggtgttttagtactgtgtgccttgacattttcgaagtttcccccagtaatatggaatataaattctgaagtgttgagagcagccaaaatttttaatgctagccattcatcatttaatgctagccaccaggtctgggaagtggctcacagttgacaaagtgggaaccagagtttggatgccactgagtgtggtaacccaccagtaattctagcactgaggaagctcagatgggatccgtggaacaagttggttagctaacatagtcgtattagtgagctctgggtccgactgagaggctctgcctcagtgaacaaggtgcaaagcagtagaagaagattctcagtgtgagcctcaagcctctacacactcccacttgagtgtgcatccacgtgttcagttaacacgcaaacattcatacatgcacacatacatacataaataaacaaaaaataaaagaataaagtcaccaaaatggagaaaatgataactcagtaaacagaaagctgtgtactctaatcagtaaactatgcccagtcctggcaaactccattgtaactaccatgtttagggttgctagagtctagatgaagatttgtaattattttctgctttctcattcccagaggttgaaaaactagggtctgcctccagaaatctaagattttaaattttctcaaatgaaataaaactaaaaattgcatttgccttctatacaaaatatccaatcaaattgaaatattcctatgtattagaaaatcttcaaaggtatttctgtagggactagggtatttaggaagcttcagtggtcggagtgtggtgactgatgtggtcgttgaaatcgactgttacaagcatgcaggctactggtaaatactgaggaatgagagaataaaaaagaggcaaagaaaccaaaagcccctttacttcagtgttccagctgtgtgtgtgtgtgtgttgggcgtggtctttgtcactgtttccttagcagagattgttcatgtggaggtgccatcttctaacaggttatgacacacctccgtgtgatctacgagcgcatgaaccagtctctgtccctgctctacaatgtccctgcggtggctgaggagattcaagatgaagtcggtaagtgagctgtccttcggatgttctccgagagataggcttacccccagaacacatcagggctgagagtcttctgtgtctgtcacctgtgcccaggtgcctacgcgttgtacagtacattttgtgggttggtggagggagggggggtttcacacgtgtgtgaatgagtctaaaatccttcagtgcacatggcaaccaggggaaggaagataccaggtgttggaagatactaggtgttggaagataccaccaggtgttctactctatcaccccgttctcatgggacagttgctatctgaacctagagcttgggtggtggccagcaaagccccgtgatttcccttaatggtgctgggattccggggccacatgcttatacatggatgctgagggttgaagcatagctcctctcatttacacagcaggcaatctcgcccattctgccctctctagccccagatcgcctcttacagtgaatctcaccttggctgctgcttcagctcttaactttcaatgcctgtgagacctaaagatgtaacctggtatagagaagaccttgaagtcttcaagcagtgaatcagttgttgaatcccatgtcaacagtgatattctaatttatccaatcttgtaggtagatactcactaggcttctctactttataactaagcacagtagttttagcctaccctgtgtatcgagagctcaactccccatttgtttttcacttccttaaatttcttgtgactgcacgtttcagttatgtttggaagacagagatcagtaataagtcctctatataagaagtcaagaactgggtacagtaatccatgcctgtaattgtggcacttgtgaggctcaaacagggaattgcttcaagttcaagtccagctggtactacggagtgagttcaagtccagtctaggatacacagtgaaacctatctcaaggaaaagataaaaataaaataaatatatataaatgaaaacagatctccacaagggagaaaaattcaaaacataactcataatcttactgaattgaagttaaaatttctagatgtgtgcattaaatgagtgtgctttgtggttagcgtcaccctcttatcctgtgtgacttacattaaggtagcattagcaatatcaaactatagaacaataagccattagaaaggaactgtacctaaacccgctaattacagttggcactctctggtttctaatttgctctttgtagagcttctcatttggcattgtgctcctctaaatattagccacaagtgagtcggacagatggcgactcaaatccctcagtgctgcaaaatacccaagaacgggaccacccagtaacttaaaatctcagtggcagagagatggttaactagaatcacacttgggtttctgttctttctttcaataaagtaagaaactgccatgggggtagatcaggaacaattacgtaaaaactaggactggagggatggctcagtgagtaaagtgcttactggacgtttagaagacctggattgagatccctcgcaccaacatttaaaaaaaaatgtcagtcatgatgacatgtgcctgtaagcctactgtaggggcaaaagcaggtggatcgcaggggcttgctggccagcgctactgcacctgtgtcagtcgataaggagaagaagccattgaagaaggcatcccaacatcaacctatcagccttcgtgcacacacacacacacacacacacaagattcctgtcattctacatatactggagaccacatacttacagaaaatctttctaagatctttctcttggaatcctggatgctatcatcttaagatagttgtttacataggaaaaaccacttgctgcaatgaacacattacagcctgtccactacaggcctgtgtgccctttaagctcctgacacaaaagcttgaggtacgagttcttcaaggacaatgggcttccttggttgtccttagtgggcttcctgaagaactgtgacacaaacaagcaaatgaacagccagtaaaactctccatcacatcgatgcagacaaacccaaaatcggctctgtatgctgctcacaaaatcctttatattttaatctctttacttttgttcatatttgaagtattccataatgaaagtgtgatttgtttgttgttatccaatgcaaagaagaacctcatagagtccttccgattggcaccttacagtagacacagtcgtctgtggattccgttcacccaccatttttccctaagttatcaaacttgaggtttgaatcagttcggtatagataaggagaaagccacacttcagttggcagaagggtgagatgggaaatatagagatgctcgtgtgttttgggtaaacgttggcgcctttgtgcacctcaactaggataagctcaattcagtctacagcttggaaagaatgcagcattctactgcttaacactcatggttgctttctgagtaaagggttttaggctgaggatctgccagtatcagtttttctttaatgacacaggtgtatctctctcagtgaattatgcttccaaccttaaatctctattataggccaaaatgggtgagaagggggccttaactacaaagaagttatgctgtgtggttggaggtggggactggaatcaagcctgtaagaaagaataaataaacaaaccaaccatactgactaggaatcatgctgccagggaattctggccctgatcatgttaccccattgtgcttccctgaggcagcccatctggttaggctacagccagctctagtaaatcccaaatcggtagttctagtaaccacacacatatgggtggccttccgtcatccagcatcttgtgtgcctgagagactctggaccagtccttctcaaccttcctgatgctgtgaccctttaatacagttcctgatattatggtgaccccccccaaccatataattattttgttcctatttcataactgtaatttaatattatgaattataatgtaagtatctgatatgcaggatatctgatatgcaacccccgcaatgtggtcacaacccacagtttgagaaccagcttcggtagactctggaaccacacatttgaccttgtcctgcttccatggtctcaggaacttccggccgaatatctgagcctttacctcgcattggccgcctcacccaaattctccctctggatggcctgagcaggacaggtgtcctgtccttggaaagtcgcatccctcaggatccaactgaaagcctcagcagctctgtaaagtcttcaccgataacctcagagggcagagcaggaagcaatggtttgatgagctcagacgggtctgcccatgacatcagtgtctaggtatattgtgaaaggtcaccttggagtactggaccagcgcatatagaaggagcaggaggtctaggggaggagtccgggccctcggtccctcagacattaggtgtgtccacgttcagcaaggttttcttgtattttgcacaaaggcggcatacgggctaatatcaatggtgaagaattctgtggcagtatctccagctcataattgaagaaactggatcctagagaggccacttaggatgatagtggaggaataaaactgactctgaggccagggtcttgcctgaatcccacatctgtgttctctctggcacccattgtcttgcaccgtgagttctcttctctttaaccttagggtctacacatagggtttaaacctgggaggccatactctagcttgtgttgatttctatgtttctatcacagcaatgtccaatccgctgagctctgctgccatccatggtctttgactgtggttctagcagacagcctggtgtgctttagagatttccgttgctgtagtctaggaatgaggcaaaccgtcacgctttgaggtcgctgtcccttaaattatgagatgatctgtttcttgataatgcccaaacctccatgctaagctccttccttgacccctcccatacccattgcacgaagtacctccctttctgctgtgacaatgttccctaaagctgttatggttgatctacccaacagaatgatgtcatcgggcagtggcagcaaagtaaagaataaagcagatttcccagaacccttttttaacactgtataaggaggtttgggtcgcagccttgacactgtgtcctgtggtcatctccagagtttacacagtcacatggttggttgattggttgattaaccatgcatctgatttggttctcctaagtattgtctaaactgctgttagttctttttacaaaaggctgaccttttattatcttgccgtttttagtccagcttaaattattattcacaagtcccaaagcacacatactagttactattttctttttcaaaggtttgcatgtaaattatgaagctttcttgttcagaaaggttgtaagaaatgttgataaagaggggacattgccttacgtcttctaaatcctgtctaggaatgtgctgttcaattcagtgatgactgagttaccgttctgatgaaatgcagctgctcagagttcctgcccatgcaaatcgtcgtcacttcagtccccacagctcttcagctcaacgctgatttggcccacttgccattctaagccattagatgtttttgtcccttgtaatttcccttaagtcccttaagtccttgctaaattggttctggcattgaggaattttttttatcattgtccctcaagattcttcagattgcagccacctcaaggctgtaaaactgtagcagcatttcattccgagatgtctgtctcacacaaggctgtcctgaccaatttatgagttaaacagaaggaaggaaggaaggaggaaggcagctctaattgtttcacactggtttatcatttaaattaataaaaaaagtgaaatactaaaaaccagaaagaccggtgactgggtaaatccgtggttagtggggctggtatggaatgatgtgccaaggagacaagaaagccactttcatggaagagtgcttactgttgttacaactttgctttttattacaatttcactgtggcctcttgataaaaatgtccagcctccagggaaaaaaatccagcatgtctatttcagggacagtgtctctgttgtctgtgcctatgtggagctggttacaaatccaaattgggtttaaagtcgaatatttacaactcttctcagtctgacaaaatagaagagtgagttagtactgcctgagaattatttaccatcccgtgggtacttgtcagttaagagagagcattagtttcggctccaaactttgtctctgtaagtccttccatgggtgattgtttccaattctaaaaaggggcaaagtgtccacactttggtcttcattcttcttcagtttcatgtgttttgcaaattgtatcttatatctcgggtatactaagtttctgggctaatatccacttatcagtgagtacatatcatttgagttcctttatgattgctattggatggagcacagcacccccaatggaggagctagagaaagtatccaaggagctaaagagatctgcaaccctgtaggtgcaacaacattatgaactaaccagtaccctggagctcttgactctagctgcatatgtatcaaaagatggcctagtcggccatcactggaaaaagaggcccattggacatgcaaactttatatgccccagtacaggggaatgccagggccagaaaatgggaatgggtgggtagggaagtggggggagggtatgggggacttttgggatagcattctaaatgtaactaaggaaaatacgtaataataaaaaatatttacaaaaaaagagagaacattactgagagagagagagtgtgtgacgccccaggagatggagttcaagaccaacctggctgcctagctagacatcctggcttgttgagagtgagggaaccagagagatagagacgataaaattgttagtaaataagacagaggcactatttaatttattctgttcttacttgatttttaataaaagtgactgctactcacatgtaaagtcttacagctgaattaggcactcaaaaacaacatgtgttcatatttcagacagacatgaggaccttcctttggtgacttcattatagtctcaaagccaatctgttgttcccagtatcattaactgagtgtttgccttgcttgtagccacccttatttaaatgggtatctttgactccccctgaaaaaagacaacatttttgttttttgatttttttttttcaaaataaagcccctagttccacgcatgaaaatgtctgggctagtgcagaaatccccagcagaagatagtagccttcaaattagatggtattcccagttttctgacagagtgagactgggttgacgagtccccagacagagaggttagcctcctcagagtcccagccggtctttacaacgtggggaagaggcctttaacagataaactcgcccaaactgccaagtgctgttctttatatacattcctggctatcatatagtataaggtttcattgtctgactcaggagttaaattagatcaatagattatacgtctttaggaagatctgttaaagtgactgataaggtcacatgaatgtgtcaaacatccctctagcatgattctcacatagatatttccagtgcacaatagtggggaagccagtctatactagcaacacccagaaagtgcactgtccaagaacaaatgcgtaggcttggtgtttctattggtttggcttttatttttaaccaatcagtctcccctgtctaaccagaaaggcaaattgttgacactgaaacctagaatgcagcgcagtgcatggagctgtgttcctgtccgtggatgctggcagtcctcagctgaattaaacgtcatccacattgtgctgactcactaccgatctatctcttggtttttttccagataaagtgttatcttctcaaatccttgaaccactttaattggtttctttgcttttttattattacggttgagttgtgtgcgttctttgtatattctaggcactaacttatcacatacacaacctgcaaatgttttccccattcaatgggtgttttggtgggttttttaacttttgcttattttttattagatattttctttatttacatttcaaatgttattccctttcctagattcccctctgaaaataagcctatcccgttctgcctccccctgctcccgaacccacccactcccatttcctggccctggcattcccctatactagggaatagaaccttcacaggaccaaggacctcttctcccatttatgaccaactaggccatcctctgctacatatgaagctggagccatgagtcccaccatgtgttttctttggttggtttagtcccagggagctctgtctggggttactggttagttcgtattgttgttcctcctatagggctgcaaaccccttcagctccttgggtcctttctttagctccttcattggggaccctgtgctctgtccaatggatggctatgagcatccacttctgtatttgccaggcattgctgtttttatctttacacgtgtttttttgttgttgttgttttgttttgttttgttttgacatgcagttttagttgttctgttttttaattgtagacaaagtctagcagattgattctttattttttgtttttgcactgttgctttggtaatagatagacaaagccacttgaattctgattggattcattttgtatggggcactaactagttaagggtctcagtttacagattcctaccatgtgatgaagaagaggttcttcctaactaaaagacattgtaccgtgtgcaaattctgttgactgtagacttctataccctcaatttcctgcctattcttcggtccatacttctacactactttgattactgtgactttgtggttaagctttgagattggcaggtatgggttctgtacttttggatttttttggtgatggtcattgttgttattgttttaagattgctttgaacattctagttacttttgaatttctacttcaattgtgatgtttttctcaggactgtttaagagaatatgggtttgtattttttttctcattgctaagacaagttatctgataagagcagttgaaagaggggtgtcttagtcagggtttctattcctgcaaacatcatgaccaagaagcaagttggagaggaaagggttttagtcagcttacacttccatactgctgttcatcaccaaggaagtcaggactggaactcaagcaggtcaggaagcaggagctgatgcagaggccatggagggatgttcattactggcttgcttcccctggcttgctcagcctgctctcttatagaaccaagactaccaggcaagggatggtcccacccacaaggggcctttcccccttgatcactaattgagaaaattccttgcagctggatctcatggaggcatttccccaactgaatgaagctcctttctctgtgataactccagcctatgtcaagttgacacaaaactagccagtacaattgaccccttgtcaacttgacacacaaacacatcactagtaagcctcaacccttagtttcttattcatccccaagatctaaataactttaaaagtcccacagtctttacatattaaaagttcaatccctttcagagatccagtatcttttaaaatccaaagactttttacaattaaaagtctcttaactgtgggctccactaaaaagcttccttcaagagggaaaaacatcagggcacagtcacaatcaaaaacaaaaattctgggatccactcatgatcttctgggctcttccaagggcttgggtcacttctccattcctttcctttgtagcacatggcttgtcttctaggctccagctgcctgtactccgctgctgctgctgttcttggtggtcatcttatggtactggcatctccaaaaacactgctgtcttccactgtaacttggcttcaacaatagcctcttataggctctcatggtaccaagcctcaactcctttgcatgaccccttcagtccggggccatcaattgcaactgaggttgcaccttcaccaatggccttccatggcctctcacagtgccgtgcctcagctgctctgcatgaccccttcatgccttcaaaaccagtaccacctgggtaactcttacacattaccaagtccagccacagcacaaggtacagccttggctatctctgcaacacagcctctgtggtctcagaaaacacttcccaggagatgtcacctcaatgatgctggtctcttcttaattaaagttaggttcttacctccagataaccagaatcaatagtcaatagttccagtaatgcaaaggttttgctttagtagttctgatatcttgttaatcacagctgattcttcagccccagctaaccagaaccacagaatcttcacaatcaaaatagcaatggccctgaaaagactctttaatcttccctctggaatttcacaagccaggcctccatcttctgcactgtactccacattatcttccaagctcctacacaacatctgacagagctcttaacaatgaatggatggatcttctagcccaaagttccaaaatccttccacagtcctcccaaaacatggtcaggtttttacaggagtatgccactgtgctggtaccaatttgtcttagtcagggtttctattcctgcacaaacatcatgaccaagaagcaagttggggaggaaagggtttattcagcttacacttccatactgctgttcatcaccaaggaagtcaggactggaactcaagcaggtcaggaagcaggagctgatgcagaggccatggagggatgttacttactggcttgcttcccctggcttgctcagcctgctctcttatagaaccaagactaccagcccagggatggtaccacccacaaggggcctttcccccttgatcactcattgagaaaatgccttgtagctggatctcgtggaggcatttccccaactgaaagctcctttctctgtgataactccagcctgtgtcaagttgacagaaaactagccagtacaaggggtttacttcaattcatatgtatgcattcatgatggctggaaagttcccaaggtagtgggagcacaaggcagctggcctcactgctatccccagttagttaggaagcagtgtcagacaatcgctggtgcccaccttgcattggcctttccattcctgtgaatattccagccctggaagaactgctctcacccacatgtaaggtgagccttaccatcccagttaactcaatctagaaacttccttataaacttatccaaagtttatctcctaggtcattctaggccctatcaagctgacaatactattcataattagattataatggctctctatatagatcagtttgggaattattgctgttatcacatttcccctattttcagtgtatgtgaatgtgtttgaggcacagtggcccacacgtgagtacatgcatttatacacacatgttgggtacacatgtggaggctggcagctgatgctgaccaacttttcccctccattctactccatttacagttgttgctgtagggctgccctctccaccccgctggtacttagatcctgggaattcaaactccattcacacttccagaaagccttgtgcactgaaccatctccccagactcctgttataaagttttaaataaggattaattaaacaacaggatgctacagcaggccgtgagaggattctagctgaggcccactgtgacaaggcaagttcttaaaattagtggaattcacgcttttggctttcacgctattattttagtaaaattccaaaggtttggtagtcctcttgtcaagatgtgctgtctctactacctcagtagcttctgtccgttttcacacagtcacttactttgcagtaaggagcatctctaccagatgggtgaggcttgaggcagcatctcccaccccaagctgctgattctcatgaagatgcggggagtcattttcccagctccccaactcttatgtgctgtagtttgaaacaaaacctaaagagaagccctagcaaaaactgagtagggtgtgaaagcagaccacagcggtggcaagatggtttcctggcacgaaacactgcaacagatgtgtcctgattccttttcttttctacagtcttgggaaaaaccaatgattttggacggtaacaagggctggttactctatttttcacaagcagctgccttcaaggttctttttttaaaagggaaaaaaaatgtagagatatttgccacccagaatatggaaatgaagccaaattaattttgaagtgtgcttccacaaggattaactggagatgagatgagcttgtttgcatgtgagtcagagttgggaacgaatgtaatttgcctcttgctgttcctctcagaaacaaattctgcaatgtagtcactgaggaagcctcattattctttattaatagctcttaggtagtgtgtcttgtgcagacactgttagctaggaaatcataaacagggagggtgtgtcaacagggctggagggatggctcagcacataatgctcttagagaggtcccaggagaggttcccagcacccatgttggactgcttacagcttctgtaacaccagctccaggcgatctaatgccctcttctggccatcacagccatgcacacacaagaacacacgtgagtgcactcacacacacacacacacacacacacacacacacatacacacacacaagacttaatattcttaattcatgggtcaacctgttgtgttttatgagagagagagaaagagagagagagagagagagagagagagagagagagagaaagagagagagagagagagtttggtggaggcacagtatggtgtctgtggaagggggtggctctgtgggcccatgctgaggcatcccttccccctgaggtaccagccacagaaaggtatagtatagaataactttatgtgcctcagtacaggggaacgccagggccaagaaatgggaggggggagggtatgggggacttttgggatagcattggaaatgtaaatgaagaaaatacctaattaaaaaaaaagaatagagtttatttagggcatggggaggggagttgagacagagaaaggcagagaaatgggggagggaggagaggggaggggaggggagcggaggggaggggagtggagggaaggcaggccatgagcacatggagaggtggggggagaggggcaagaggaatggggagagaggggtaagagggtaagggaacaagagcaagaggagaagagaagaaagtgaggaggggacaagcagtccctttcatagtgaatcaggcacacatggccattaccagggaactgtggggtggggcctagacgaaatgccaacacaaccaattaacctattctattatgagcgctgtccagagaaacagtattttgatatgtgtcaagacactattcattcagggtatgttagtatacaccaaaaaccttatcacttgggagactgaaagaggagcaacttgagttcatggctggccttgactctaccaggaaatcctatctccaaaagacaagggattaaaaacaagcaaacaaataaacaagtagtatttgcaatgcctttgttagtgggtagagtccagttcatttcagccactgctgatagatgatgtattagcaaagacaaagaatttactagccatttggtgcactgaactcgttgttgctgactggcatttgttcataaaggtgttagctacatcttttgcttgaaaaaaagcacctggcctctatgaaattaccctatctctgcctttgcttttggtctgtgtagcatttagatgtgtcttcccgtcctgagacaaggctgtgtccctaagtctgcaatgtcccctattacactgaactctgtacggctgcgtaagtaggccagttgtgaaaccagacacatctttggcctaaacaagggaagcaagctgggtagaatttcattctggtacaaacactagcctgagcccttctagccctggcacaccagctgtgtctcctctttccgaggttgtaaccataagcggaagttttgcaggtgcctgggttcctcttgcagccttgcctcattaagaaggagcttccaagtacagtagtgcaaagttaagagtgtaaacgagagtgtagcacgttgataggatcatgcttacttgcattctataatgtttttatttaggaaacagtgaaagcaaaccaagtttcacattctgaaatagtgggtgtggaggcctctttgtttggtttgtttttttaatgtgtgtgactgtttgcctatgtgtgtgtgtgtgtgtgtgtctatcacatgtatgcctgatgcctgaggaggccagaagagtgccgaatcctttggaactgaggtgatggagggttgtgaactgccaaatgtatgttgagaactgagctctggtcctcttcaagatcactgagtactcaggaccaccgaagcttctctcgggccccatacatgtttcctaatgaaagtctgtgatttaaaattcaaagttaattgttagctttaaatatagcaaccttcatttcataattactgagtcttaggaagcaactgagagttctcagatgatagccaatatcttctctataaaggaaggttgctacacatacttgtcctgtgatataggcatcctgtggcatgaaaatgaatcattgtgtcatctttctttgttacaataaaacttccctaggaactctagccaaatgaagtgcttattgctagaagttgtcaaagataccaataaacagttctccagagtttctatttgtgaaatgtagtagttgctagtatagttttaagtgtagttttctaatagtaaatatctgttgcctaatacaaagaaagtttagtgttgccactgaggtagatgagtgacagttttcagacattattattatctgaaaataatctttgatgatttaggtatatacattttacattatatatatgcatatatatatacacacatgtatataatgcatatgtatatatacatatatatgcacatatatacacattattatacttttatatgactttcaaaaaataagatgtaggaaggctgggtgtgacttacttacttacataggagagtgcttcatagcctgtatgaagcctaggtttcctcctcccacattgcacaaaacgtggtatgatggtgtaatacctgcaatctcagcacacaggtgatgaagacagacaaatctaagaccttggctacttagtacagctaggcatgaaacactgtctttaaaaaaaatgtctatccatgtacatacaccgctatcatttgccactgtgagtaacaagaagatccaagaactaagcaaggatattcagcatcagtgaattgtttgttaaatacctacaatactctgggactgttaaagattcggggcacagtctttcttactcaaataacttagaataatttagaatttgcttagagaccgcagatcatcagccaagacaaggctctgttctcaccgaggcagttgatgaaggctgatctgatagcacgaggtggtcttgtctaataaccacccttcctcctaaccacctcaagaagactactaagcaagagggaagcttgcttttcaacagctcaagccacgttattttataggttcaactaaggccatacatcacatgtggtcaataatctaaggccatacctaacgcctggtcaatagcctgcagactaacccgttccattggtcttgatccaacggcactcacttagtgataatagcaaattcaaggctgaatctgggaataatatgggcagcttcagcgtcctttcactgaacgtgttacgcactgaagagttgtctcaacagctttgcacacatacatctctgttgatgtgttaaacattttgtaggacttgggggccatgccacctttctccatttgatcggaactcatatgctgaagtatgagtcgctgacagttccgtggaccatgatatcataattccccatgatgacttcaccattgattctccgggaccagccatgcaggctagggctttgccaatgtttatggtcagagacttctggcaaacagcatggaagtggtgtattgttgctggccattaaatcagacccatgaagtggcctcccctgccagcagagcagatcgcttcttggtttgtttttttccactcaaatttacaaagaaaggctaacagataatttaatgaaaagctctgtatatgtttttgtttctattattgttatcttcattttgatcacaaacttttttttagtctccctaagtcttgcttaatcctcaaaaaaatccttgataagcaaagtgtatggcttttcccgtcatttattacggtattactttatatgttttggaaacaggcctgtgtatgccaggctgctctcattcgcagtccccctggttcagcatctcaggtgctaaggaacatggtagtcgtcttcctttcttctcttgctgagtctgacattgcaggcaagctgacgtcctgctctcagccctggatacactggcatatgttctgcttatgtctacagtgttgactttttcaggtcgaatatgcatttgtatctcttcacaaaaaaatatgcccacagccaagggatgattaatagaaacagttctcatcatgtggctttggaccggcaacagcagcatcaatgagaaattgttagaagtgtgcattccttggcctcattcccagcctaataatccagctatgtgtggaatagatgtgtcagcttttatctctgtggctaaatacctaacataaataaacttaaaagaccagctttattttataatatatctatatttcagaagtctgagtctatagtccattggccctattgctttgggtttgtggcaactatattatggccagaagagcttcttagtttccggtgaccagaaggagaaagtaaagatgggaagaagaagaactgaaacaagagaattctctgtaaagacaaatccctaacttccaagaggtcccatctcttaaagatcctgctgccactcattaccaacttgggctgcagacaagtcccttaaaacatggacctttggaggaaatgtaagatctagaagtaattggtgctcagtctgtagtgatagtgctcagttagtactaaagttatgatgctcagtctatagtgatagtgctcagttactattataataatgatgctcaatctacagtgatagtgcttagttagtattacaatgatgatgctcagtctacagtgatagtacttagtattatagtaatgatactcagactacagtgattgtacttagtattatagtaatgatattcagcctacagtgatagtgcacagtctagactatgttaatggtccaaggtccagatatagtaatggatgtaaatgatacacagcttgtcttcagagagagatgtttttgctattgttagatcttttttaggggaggtggattgggaaaatgactcagtaggtaaatcacaggctgcccaagcttgaagacctgagtttgaatctctctcccctcccatgtaaaaatggacatagcatcatctgtagtccctatactcctacaggaagatgggaggcagacacaaaaacctggaagctcacagcatgagcaataaacaagagaccctgtctcaaacaggttggaaagcagagactggagactgacaactgaggctgtcctgggacctccacctacacaccaagttgtataaatgcctgtactcacatacaagcacatgtacatacatcatacatactaatactctctcttgagtgatgttgcctgtaaaactatagagctgtaaaggatggaagatattcaaagactcgggttctctctctcagacccccctttaggctgcctaccccagtgtccttagactttagaacaaccgcagtacaaggtgttggctgtgaatactaaagttcaggaactaccggtggaaatggttgggcctaagagaactatgagtgtgagatgatctgctttcttcctccaggatattacacgtgctcatgtgagcttagagctcttaatttgtatgtaactgggtaaagggagaggactatttcctaatgtgctacctaccatcttcccctcggatttattagagtaggtgatgccagataaaatgggttcaaccaattctttgagtttctgtttgtttctctgtactttgtccggaatcttttatccaaagtccttgggattggaaatgtttcagatttcagaatttttcaaattcggggcacaacgctaccagttataactagctatcatcttcagtccaaagagctgagattcggaatgctttgaaagctttagctttcagaacatcccacatgtagagtctgagagcaagcccatgcaatataggtattcagaatatatcagagagcaacagtaaccctcacgtttactactgaagaccaacctgagccgtttccagtctgctgctggcaatgtctgtgatcctgagcaaaatgggagaaagctgtctcaagaaaaagaggtggaagccaagggaagggctttgtaatgtgttcaggcctataggagtgcggttagcgctgagcctgtgtttacattccctcgttcccttaggcagggagccagtgtcttgcactgagtgttttgttttctcccaccttaaggagaagccttcttatacctaaagcagaaagtacctccttcaggtgcaggagggaaaacttaagcaatctgtggattgctcaaaacacagtctgtcctttgataaaccaggcatcgccctgcaagtcaaacattgtatgaaaatgtgagaggtttggcagactgttctctttgatgtggagagagaaaagctggcttcctttcccacattcagctcgggtctgcatctaccctgctgctaagaggctcttcaagggaacttgaaagtggtgccggaccctccagctttgcagattaaggatctagggtgattaactgatttgatcaaaatcagagactaaaactggtcaggggtcgagggcttcttcacatcttgccagagttcttcagaaatcaaagtgagttttaaatacctggggtgtgaataaatgagacaattttcttccattaaagaaaagtggccacgaggaatggggaaccctttgtagacatcagagtgttcaaatatggccttgtgtccaacacggccttgtgtccaacacagccttgtgcccggagcttgccacgagttgaagcgagcatctaagctggcaggttccggtccctcgggagttcatcctgtcatttctgcatgtctgtcccttactccgctgacagtaaacagtgtctacatttttcaggatcttacttcagttgctgtaaatacttcaacaatctgaaagtctcattcagaagccacttaggaagaaaagttactctcagtggaaattggtatcctggaagtcactgtgtctcaatgcatacttgggaccaagtaaagtataatgtggaggagttcttgtttaaaataccgggtcttgaactcttcctcacactcagagaaatcaactcatcttctacttcaaatgattcttgaataattcaaaaggtttaatgtttatatgtgctagtaaaaatacaagcttttgtagaaaattgagagtgtatttgtatatatctttgacctaaaaaattaaacattattaatgtatcctacatgaagttagaccagtctttcccttcagtctctgatttacagtgttctgacttacaagattttctgacattgtagcgaggagaaagtaatgtgttttgaatcataatccgtccccgggtcactacatgtggtgccagcatacagcactgcgtggcaggtccttatcttagtcagggttaccactgtgctcaaacaccatggccaaagcagcttggggaggaaagggtttgtttgatctacacctccacttcactatttatcgtcaaaggaagtcgggacaggaactcaaaaagaggtaggagctgatgtggcggccttggagtggtgttgcttactggcctgctttcttatagaacccagaatcacctgcccagggagggccccaccccacccccatcaatcactaattaagaaaatctcccacatacaggcatgtgtgcaacctaatcttgtggaggcattttctcagctgagtttccctcctctctggtgactttagcttgtgtcaagtttcacatgatcaagataataatcaacaatagccctcactctctcatcttgagctctgctgttcagtggactaggtgcagccgtggcatgtttgactaggaatgttgtgtggaaggaccatgaggctatattcgcatcatgaaagaacacatgtatttccaaggggccactgcataaaatacttccgggagatgacatttactttgaaggttgaatacagctctgttaagtaacacaatgttgaggttgcgcttaacttacccaagtcactggcataaactccttttctctttgtttttattgtgttcatgtgtgggcacacgcacatgtctaggccagaggacagcaaaaggttttgttccttagctctttacaccatctgtttgaggcaaggtctctctttggtctgcaagtcacccaaatggactagactgattagccaggagccccaaagatcctcctgtctccattctgaaattataaacccaacaccacacacagctatctccctgtctccctcttccccctctgtgttttggggggcaggacaggttatatccatacaactcagatcctgtgtgtgtgtgtatgtgtgtgtgtgtgtgtgtgtgtgtgtgtgtgtgtgtgtgtgagtgtgtgtgtgtctgtgtgtgtctgtgtctgtgtgtgtgtgtctgtgtgtctgtgtgttctgaccacaaaactcaggtccttacctcctgacccacgcacaccccccaaacccgccaacttaaccacttattaacctcagtcactgctcttgacagtgaacagtgaaagcctggggctggtgggaacttcttgcctagatgctgctttccttggaagttcagagcctgctcgtctctctgacagatccttttcctctctcagtcctgacccttcgctctcctatcactgattccaccatagaaatactccatggaggtggccttcaaatccaagatgatactaacttcatcagaggcaaaagagaagattaatgctatgcccagggtgaccagcattgtagaggacattcatccgaatctcggacagttcactgacagcctagcatccgctcaggaagtatgtgtccgatagtgaacggacaaaacaagaacacgagaaaagctatgctggctgccaacactagatgccagtccccaggagggagctcactgtgtcacacggtcacatgtgtatattttagattacataggaaaaccctctaaaccccttttgtggtttcctgaagtgacatggactagaaatcaaataccagctcttcttttattccacaaacaaatagaccacctgattggacatgctccagaaatgtgggaaagctatcattggctattttccttcaacctgtggtgaacaaggcatgtggaaatagaatgcttaagaagagagcaataaaaattaaaatcatttccttgtcttctctgtgaaggggatgtacgatcatttctccctgtttagatatccaggcacatgcctgtaatctcaatggttcccaagttcaaaggcaggctagctacatagtgagtcccagaccagcctgggctacatattaagactctgtctcaaaggaaatgaaacaaaaagaagtatgtttttcaaagcctttttcttgcgtatccagagtgagcaggattaatttaccctcagcctgcagctgtcacctttcttgaacacagagaagaaaggaaacagaatcccttagagaagacatttagatctcttccttttgcctcagtctggctagaaaggtgcagtagtgacctgggttagagttctgttcccatttgccctctccagactctgtgtataaaattgatagtgcgtacacatcacacacacacacacacacacacaccacctgttacctcataagcgatagtttattctgaagccaaatgcgtctggcagtggcctggaacacagatttattttctccaaattccatgttcctacatggaagcatcttatagtaaccaaacaaagaaagccataagtcaagacactccgtaaaggcatcggtggaaatatcagggtagactggttgaggaagagcagagaaaccccacctgtagtcctcaggtgccacctgatgacattctaagcttgctgactggttggctaactctagtttgtacatccggagggatttacctaatggtcgaaaaggagctgggtcaggtataaaggagaacagtacatgactgctgcaggggctattgagggcccaaagctctacacttgctgccttccagagtttctggtctctgtggttctcatcagttacatgggcttacagaagggtcagtggaactttccagaatccccaagtgtatgtgttaattgccttgaggtgcagtctttgggtggcagttaggattgggttccgtgtagctaagatcttcatatagaagcttgccgtggacactctgctctgtgatggcccagtgggagatcccttgctacatacgggtaccctgctctctcttttttttatgtattagaaagagaaggatttgtatggcttttgcttcttttgttttgttttgttttgttttgtacactgagaagaaagcagtagacagaaacagaagaagcccctgcagaaaccccctttataaattattcattctctgatcctcagttatgacagaaaatagaacagcctcaagcttagggtaatggcgcaaacttatgatttcagccactcagcatactgaaacaggaagatcctgggttctgggcagacctgggctacattgtgagatcctgtctcaagaaaatacagtggtttgaatagcttaaaaatgaaagtgacttttctcatgttttttggagctcgtaaattcaagatgatgggtatttaggaaggccttctcagtttctccatgatacaatttgtttcatcgtattgggagcaaggatccagatgttctagaggctgcccctggggagttcctgctatgctggaacaaagaactggcccagggacacgtggacagtggtagaaaaagacatgatttattaagaaaaagaaagccattttcaggatggaactttgagagatttggacacaggtgggccacagttcaaaacactaacggtcctgggttcttgagcctttttagatcatgtgtgtagcacccaccttcccccatcttaggagatcacagaggttttctgtgtgtgcatgctgtttggtcacatacagccacaggaagtggaggttgtcttcctgccatcggttgctttcctgtgctgatcttgatgtttcttcccataaaacctgtcttggaaggagcaatctctctggtttctccccagcctcagcatccagtcaccctgggataatatttagcgtcagtcttcaccttaaatggctcttctcaagatgatgcccttgagggctaaggcctccatggatttcatcggggatccagttcagcccacaccacttagctgggtcagtcctttggctaggtctaatgtcctccctctctgttgacccttaccctttagccacttacagcgcatgtgctctttattctaaaagctatacacagaagccatgacatatagtagtactcttaatttttaattttttgacatcttgaattggaatagaattacatcaattctccaacccctctcagcatccctccctcaatccccttctatgctaccccagtcttaggttggtagtctcctcttcaaatccaaaataaatactctggccaccattttttttatgttatgaagcctgagagtcacaaacaacccagcactgctcgctaatcgtgcactccatggcccaatctagtcatcctataaaaacaacagcatgaccttcaggctttttgaagatagttttgtgcagacccagtttgtccagtgtgagccctaagttgaaatcatcaggctaaattgcacggcttcctccagctgtcccggcttctctaaatggagtccctgggcttgagtgcagagtgcagttctcctgcctctgtgatggtggtgtcatcactctgagtgcagtaagatctaaaactcgcctggtatttgccacatgtcttggtgccaggcacaactcagcttctccggctccccaggaaggaagtgacatagccgctgtgtacgaggtgcttgaatgaggctactccattttcctgctgacttgaagaatctgcagacacttcccccaaatactcccatgtttaaatcaaacagctacatgtcttgaatcttcaccctacacgtgaaaaaaaaaagattaatttccatattacgaaactgtaaaaggttttaagcgcctttccttcctgtgaggctgataaaggagtgaatttgtaaactgcggctgggttaattagccagggttaattaatgtttaccacactgggacgatgaaaagaggtgtgtaaatgcacagtaatgcgggtcatttttcaatttattgttgaagcttacggtgtgtgtgagtgaggacaacataaagcgcatgcgtgtttcagagggctactgatgctctgcggtaattatgaggcgtaggcttctaagtggattaattacatgttcctgaagacgatcacaggctaatagtgtttatttagggacaggctgctgtttcaagttgaactatttggagagctgggtgaggtgaggagaggctaactgtgtgggcatgaaaacagcattttaaagtaacctttaaaaataaataatagatagatttctagagtcgtgtattttcaagagagcccaaagagtcttaggtgaagtcctggattaaagctgggaagtacagatactagaagcagtttgaagagattggaatataatctcctatgaactgggtagatatccctcagtgttgggagtttaggaccagattccaggacacgcccacctcaggaatccccaaattcatggatgctccaactccttatatagacagtttgtatttgtataggacttatgagcatcttcttgggggctggagtgatggctcagtggttcagagcactgactactcttccagaggtcctgagttcagatcccagcaagtacatggtggctcacaaccatctgcaatgagatctgatgccctcttctgatgtgtctgaagacagctacagtgtacttcctgagcatcttcttgtgtgctgctcataaaacctaatccattgccactgctcagtcaacactcactaccctgtaatgttttgaaaacagcatggtaaaagccctatttgtgttcaatacagacacagtgagtgttttcccattaacttttgatctgagtgccggagagttggcttagtggataaagtctttgctatgaacacgtgaagacctgcgttctgatccccagggccgtgtcaaaagcaggaatgacagcatgcacctataatccgggccctaaatgatggaaagagaagtgtctgaggaataggacatcctagtgcttgtgtgggtcctttcctgtcagccttgagttctttgcatgcgaagaaattgagttagttatttctggcactggtctggaaatatcgacaaatgagtatcagtgagctcaccacgtaactcgtttgagtctccttgttccagattcttacagggatttcttcccactcctcacctctgtgcactgagtgccttcctgaaggcaggtcgattccacccctggccaaacccctaacgcttagcacttgccatttccaggcttggatgctatcttactttttctgttgctgagataaagtaccctgaccaaagcagcttaagggagaaaggctctatctccgcttgcagtccaaggacacaatggatcaaagcagagcagccaaagctgcaggtcacttgacatccaggacgaggaagtggagggtggtgattggtcggttcttgttaatttccctctttggcctagtaggacccaagcagagaaaggtgtgacccacatttagggtaggtctaccttctgttaacctaatgaaaccgatccctcctaggcaggcatggaggctaacttaatctaaataatcctttgtctccttggttactccagagcctatcaagttgccagttggcgttattcttcatcacagtctcctgggcctcgttaagggaccatgtgaatgagtttctgctggagagaaagggccatcgccatagctaggaaagcaagatttcgttaaagacaaacaggccagtgtacagaagagcatactggatgtgtttagggtttctaaaatatgcatacattagcatttaaatgagcggtcatgcctacagagatgtattgtgtataaggaacatagccctccattgtgatgacctgtgtatttaggcacattttccacactgagcccttatttatcagcatatcttttagggtctccccatgaaattgtctacagatgttggcatcttcctttctaccacgagctcaccatcttttgacccagttttttcatccccctgaatatagtagttgtccgtccctcatcaactggaactgtactgagctctcttcctggcccagcagtgtgtgattcccattccatacatctgctgtggtcttgagcaggccaggcagggttctcttccaagtctgagggagagcacttgagagcctgggccactgcatagctacagttgtataagtcgcacaggaccctgctataacggacagcagtcatggaaaccacagtgaagagttgtctgcagctgcacagccatgaacagcagtcctgtggccatgccagcatggccacccgcccctgcttctctctctgatgtgtttgaagacgcacaccattgctgaagtccaaagcacgtgtggcagagccagtcatgggctgtgcatgtgactcactcgcctcaaagaaaatgttatgtccatttgtaaggagagaggttgatttccttaccagctgtctcagaggtggctcggagctcaagtggggatgaaagaaccccaagtaatgatgcccagaacaccctacaggagccgagaaggagccacgggactccgggctcaattaattttttttttcatctcttactctacgtttgtttttttattggtccacactaaaaattagtttttcataataatagatggtgctattataaatattctgaccttttacttttaagcaaatatacgtcaacaccaagtattccaaagagccccagtaaaatgaaaattaaggatctaactggaaagatttcttccccataagtccatatttatatgtccccaaacctaatagtagtctcaaagatgtcattctctatggccacagccataaagattaaataagaaaacaagacgggacatcctcttggagttgggggaggaggtatgggatgaggaacagtcagagggtggactgggaggggagctaatgactggactgtaaaaaaagattcaataataataatgatgatgataataataataaataagtagataaaataatttctaaaagacaaaaatgaaaaataaaaatgtgagttaaatgtatagtggcctcctagtgctagattttccaccgtgtgattcattttccaagcaagtacatccgtgtaatttacacgtatgagcattagaacttcagcccacagaactttctttcaaagaccagtgctgtagtgtgaaaactctgcagtcagggccccaggtggctgacatcccagggggattaagaccccctaaagtggttggaaataagatcgggaccttggcccaagttccataaataaacacggaaagggaagctttttaatccttttgccaaggccagggagcctggctgtgttttcatcttgatttctggctaatgccggttgatagaacggagctgtttgatgtaggagtttgaaagccacaaggaaactcctcttcaagggaaaggcacttcttctgaaacttcagtctagaccagacgatggtatttcaggaaaatgtcacttgcaataaggagtagttttcacaagtgatgctccgccttctgtgagtcctctctggggacagttgcctaccataagtggacggaacacacccccatttgaaactctgtggccaggaaacttctacacaaaaataaacctcgatctagacatgagtctgtacttagactctgggcaattctcgagattgatagtgtagctccagataaaagagctgccttaattttctagacgcggaggtttgtggggagagctcattgctaagtgatgtctatagaggttttccccccagtttgggaaacagtcctacaatgatcattctctctcagccactgaggtaacctgatcactccacttcatttgggcacagaaaagatttgtggggcagagcccaactcaaattcagattgtttaacttctcttaactgtgaagtagggtgttgaagcctagtgggggttcctatggcaaccaaacagcctcctcttagattggttacttttctccttgcagagacaacatctgacaagaaccaatttgaaggaggaagggatggggtttggcttgcagtttaaggggagatagcatgcctggtggcaggaggcaactgttcacatagcatccaaagtcaggaagtcaggagagggaacaggaagtaggactgggctgttaagtgttcaaggcccaccctcagggactgacttccttcttctgtgaggcttcacctccaagagtcagcaaactgactcttccctgagagcaccagcagcgatgagctaagtgttcaggtccatgaggctgtgcgggatcatccacgttgatatggcagttcccacagtatttcatgagatggacattgaagaagggaaagacagtgagtgttcctgggggaaagaaaccattgttggaaatggaaaatccaaacagaactgatggacaacagcttcaggctctgtcacacttccctaatgagcctctagagctacacctttaacctctttggcctaagtttattggggggggggggaataataatcattgaaattatctctttctaaataacatgaaaattctcatgggctgatgagaggattacattaggaactggggtcctcaggtttcagttatagtatcagttctgctactcaatatgtatttatctacatattatttatttttgaggcatattctcactccatatgtagtgctgtcttggaactcactacatatccaagctggcatcgaacttatagccctccagtttcagcctcccaagtgctagtattgcaagtgtggggctagcacatgccttgtttgttgattttaaaccttctgagaatggatgtttgtgcattctgttctcagtgggggttgctatgggtaccaaatgagccagtgagtagctacaaaggccactgatgtggacagtgtagggagggtagtgggccccccccagcccccaaggtatagcaggacttgagtacttggtggactggtcatggcattggagatagctgtggtttgtacgtagtcagagtgaatacagcaaccataggaagattccatgtgtccctgcaagtcagcatctctattagctgctgcctcacaaagccaagccaggtctgtccagccaggctggtctgcgaagtgtccacagtgcagaagtatctctcctttctgggaggagccaggaatgacgtgtggcctggtgctttcttgtgtgtacgttcttattcttggagactaagaaacatcaacctattcccaacacatctctgtgcttccccttcctgcttaataaatgatttggccaagaaggaaatcatggttgttttcagttttcctgggctatcctggtacagaaatgtgatcttgaacgttagttttaaggcagccaagtgttgggtttgaaaactaagatttgctgaaggcgtcctccagcgcacgtcttctcctggcagtggtggtgcttagctgagtgtgacacactctccgaaaactggtctgtctgtgatgacgggaactgaggtcactacattcttgcttctgcactgcatggcttatggctccggtcctctcagacttcaccacaagtgatgactagcctttgacagttgtcacctgggagccctctaatatgcagatttgctacctgtatccaaggagtggaaggggcacgaggattctgtcttttctctttctgagacaaaagtttgctatgtaacctaggagatcctcaaacctcctatataccctaggtaagccctatacttgaaatcctcctgtctcagcctcccaagtgctggaattataagcatgctttaggacacctgtaggacaattctgtacttccaacaagatccccaatggacacctatgtcccgagattgagtttacataacagaatttaagtgatggagtgccagagactgtcacccaacctggaatcttgtagataaggaatacaggcttaaggagtttcagaggccacggggacattaataacagcatcacattaatagactgagccaggggttagacatgcacaggctctggttggaaaattaaatctgatctcatagctctagtatgggcaaaatgcctagaatggatgatggctgatttctagtcaagctctttgatggggaaaaattacagaccttcttccagtgcacttggagccaaaggacagtgtagggaagtagcaggcagatatataagtatctatttaaaacattaaaatcggttttaggagaatcctctgttaaacaaaattaaaaagaaactcccattttggtggagatcagagatcagtaatttttcacagggagacaaagaatcaaaattaagacaggtataatgtcaataaagattcagtcctagaagaaaaacagagcaagcctgacaaaccgctggttcagtggtctaaactagccctttaatagccttgtttgacaaggttaagataactcctcacttgtatgaaaaataaaaaataaaaaatactcagtatgtccagtacacagaaggcatcagtctgtaattaccagttattatgaaacttgttagaaagattgactcaatgactataaattttattttttagaaacctgaaatgtagcccttaagattttgaaatttatttggctgatgtgtcatttaatagttataaggagactctgggatggaatacgtaggattcgtgtcttccctcctctggcagacctttattcatgaggccctttcgctaaaaacaaatggccatggacatctttagtgtccaccaaaccaaaactaaaagtttgaaatcatttgaagatgaaatcactgtgactctctcttaatgttgctctctttgaagtatcttgaatgttttccacaatagctaacgccctcccctaccccaccttcctgtttactctaagtttgatttgcccacataaatcatcaaagcgtttttgaaagaggaaagtgatggggttcactctgtgtgtgtgtgtgtgtgtgtgtgtgtgtgtgtgtgtgtgtgtgtgtgtgtgtgctagaattcacacccattatgtaaaccataagtgaaacattaccatcactgggcttaattaaatattcctgctttaaccttgaaaaacccaagtgtctggatattacagaagattcttgactggagtagtacctgatgaaatgttagatggtaacaaggtgctgtcctgaaggggaaaagggagtcttgggaaaatgaatgttgtctcttagattaatatagcaattggtaagcttggatatttaaaggcttcgatggtccttaatataggccatcaaattagaataaaatattaaattaattcaaataaaagtataacccatttgagccaccacgaacacagtagaagatggtttctggtggctttgcctcaccatgggatcaaagctcagtgacacagtcactctggtccctgccttgtcggacacaggcacaattgcccagcgtcagtgcatttcccagcggtaaaatcctgagcccttaatcacagagtagctggctgtcttgaacattttatgatcataaagtagagtcctaccgtggtaatggcaatcctttcgaatttattcagctctctgcccttaagagcagactgaattccttgttctaaatggcattgccacaagtggttatttttaaattccctacgttaaattaagataataatatggatccctgctacttgtgctaagagatttttctctcagctgaaaatgtcgcttttcttgaagatttcaacttttcacataaatttcctaatagttttttttttgttcgttttgaggtgatgcagatgatttttttaaatgtgtaagaatgttttgcctgcatctatgtattggcactacatatgtgcccactatatgtttcagaaggtatctgatgccctggaactagatttgtagatggttgtgagctaccatgtaggggctggcaactccacccaggtcctgtgcaagagcaaccagtgctcttaactactgagccgtcaccacagctccgtccccatcgtgtgaatttgtgtgctgttcacagcagtgggctatgtgtcttgtgtctatttggaggaaatatcttgccaacaactttaaggataaatgagacaagggtgccacgttgtctttgcctgaactttccgggaccctgtatgcaaatgtatccaaatataagatcttcctatgagacggacatgtggtctggtctgcgctctctctctctctctctctctctctctctctctctctctctctccacctgctctagtctgagaaaccccttttggggtgggagtgggcagtggtgggaggcaatgtccactctataaggctggtatggttacaaatcaacctctccagatgcaaggcttatgtttgatctgctccgcaaataagcactcccaggatggtaacccacactgttcaataccacagctccagagggatgctggagacgggaaggagttgcaacccacaaggctggagatatgcagggagctagggacactgaagggccctagcatcttggattaattcactacacagtggagactattgaaatgagaaggagtcttgcctcagtatctgggaaggatctagggaaggcagtcaaatgcagattggtaaagagcagcgatcagtcagttcatattgccttaacaatatctgagctcgatgcggtggtacattcctgtaatcttagaactgggcagtgggggattatgggttcaaggttatcctcagctacatagagtttgaggattccatgagatatgagactcatgtcttcaagtaaaacaataacaacaaaaaccaacaaccagcaatttatcacatttatataaatttataactaggcaatttataaaaaataagacttttgtttctcgcagacctaactacaagtttaagaagatgctggaagcttcagtgtcttagagaactcaactttcctcattcagagtggggacttgttgtgccctccagagaggacaagccctactccattaatagcagtgagagccttcacttaatcccatccccaaaccccacacaaccctgtgtattgttacttctccggggagtaagtttcaatacgtgaattttgaggcatattcatatggtagcaggcagtaagtccacagctacacttcatcaaagcaaaactgaggggaggtcacagaacagggagacgattcagaagcggacattcgaatgttgtcagtattgttaagtatgtatcgtggatagttctgaggctgagaatgtatcgacgctaactgccacgggaaggcaggagcgaagagaaccaagtctgtagtccaagaggaaggctcaagcatcatataccttccacgttgtcagaataaaagagtcagtcatgaagaaataccatttcaatgctgtccacatgaaggagatctttacaccttcaagcatgggtcattttcaaaggagaaagttggagaaggaaatgtgagaagaaaaggttaagggcacagagcttgcttattttttctccttccttcctcccgtccttcctttctctcttcctaaggaccggctgacattttcagacattatgagggaacagcaagacaatgaaaaagtttcaaagtccaggaaaagcgtggtaataaatgccatagagacctcaggcatccaagagctccctcctggttcttgcctctcaaggtggacgtgtgggcatcgataattattccaaactatcttgacttcagggtattaagtgctaaccagtcaaagcataagatttatataaaagaaatgcccacttaatttattaaatcagactttggccaagttactggccattacctgtgacttgataagacatgaaaaagtctaggagaagtctaatgagggccttttatctgtgtgggaaaggtcattgcaagcatcaaatattgaattttagatcagtgccacactgagtaggtatatattataactcaaattagacttcaaaaggactaatttgctaggggttctatcatttaaaataatctcttgtaataaaactgactctacaggaagatattaatcgcatactttaatgctgtcccttcaaattgttttaatgggtacacatttgagcggaatattaatttttccagtaaattggcttttttgtcaacttaaaagaggattgaaaggatgatagtaaaatgttacaagtcaagtataaatccaggtttaattttctttattttctccagcattgatattaactagtgatgggcttgaaatataattcagtaaactgacacaggcgtgactcagtaatgacacacttaattaatcaagtattaataccatatgatcaatgggcctctgatttttaaaaaactatagataaaatgtcaggggaactttttgtaagataataggagattcacaaatcatctgttttggggggttttggtgatggtggtagcaactacactcattatattacattctgtttttctgttcccctggtaaacttttttaataatgaaaggtgcaattggaggatttcttactggactctcagatctttgggtagatcagctatattccataaggttgattttttttttccttcggggaagatagaagctacagaaaacaaattcagggactttcatctcaggtcacttatatgatcctgagaggaagagataggagattagctcagacagtgagcattcttcagggtcctcagtgacatgccttgaaggacaaagtgtatgtttgtagctctgctgcatctggggaaggcagctgttttcagagcaaaggtcacggtgactgaatggagcaggaggcccgtttgtaatattttctcacccatccacatctgcccggaggtgggggtagacagacgctatatcttggttcccagactgcacctccatgcctgctgttaacactctaccccggtcccacatcatagcatgctgtagaatccttcatgatcactggatacatggggagtctgtggaaaggaaaaggcagttagttcaccctccaggtcttcacctctggagaagagaatcagcaacaagatcagccagtctcgacaggctcagagcagtctcgacaggctcagagcagtctccacaggctcagagcagtctccacaggctcagagcagtctccacaggctcagagcagtctccacaggctcagagcagtctccacaggctcagagcagcccatcgggtcaaccactaagctctgactttccttaaggtgcttcgttttttacatgttaggtggtgccaagtgacacctcgtcacacacggcatgtagtcagtaggaatggccgctgtaagcgtacgctaaccgaggacacactggcttttctttagatgagctgcttcagaaggagcagaactactccgacgatgtcttggccaacatgatcagtgagcccagaatcagctacggaaacgacgctctcatgccttcgctgacggaaaccaagaccaccgtggagctccttcccgtgaatggggaattcagcctggatgacctccagccgtggcacccttttggggtggactctgtgccagccaataccgaaaatgaaggtaagagtccctacctggagccaaaagccttctgggtgggtgtggcctatgttataggtccccatggtaacagttgcctagagtacttttgagagaaggacctggtgtgtggcagagatctgtgtcacccgcagggataccactcctatagattagaggactcacagtatatgctgtgattgccccatgtgccgtcttcatctctacattttaaaaaaggtaacaaaaataaactagtactttttatttctcctttccctttgtaaatttacatacatatttacatagagagaggcacacacctaccaactgtccaagactggcatgtacaatatagggaaacaccatctcaaaataaaagtgcataaggaaacatagatcaggtcatggatgactgtggaggtggggggcggggtggcagagagaaggacagacagagacacagaactagagacgcacatctttggactcccagaaatccacctgcctcctcctatgtttgggaatttaagacactgggaaataattatttaaacatactctcactgggagttattttatctcttccatgaaaccaggatttgatttgcgcttctaagcttttggcccagaatgtccacctttaatgaaaagggtgaccaaattaagggcagaacttggtcccccagagagaaggtttgacagggccttgtacagtagacagacgctgaaataatcctcctcagccgccgattcttactgaaagaatgcagcgaacgcaatagaatgagtagagtgaatgaagcaagtttacgtcagaactaaagagaaatgatttctcgatcaacgaatctgcacacctgggtgatgtaattctttcaggggggattatgttagggcttctattcctgcacaaaataccataaccaaaaagcaagttggggaggaaagggtttgttcagcttacacttccacattgctgttcatcaccaaaggatgcaggacttgaactcatacagggcaggaacttggagacaggagctgatgcagaggccatggaggatgctgcttactggcttgcttcccctggcttgctcagcttgctttcttatagaagccaagactaccagcccagggatggcaccacccacagtgggccctccgagccttaatcactaattgagaaaataccttatggatttcatggaggcatttcctcaagggaggcgcctttctctgtgataactccagcttgtgtcaagttgacacacaaaaccagccagtacagggacttagaagaacctgtttaggaagcaacaaaataacctgttagcttattttgccatttttccatgttcagtacaaattgcatgcacacaattaccttgatttcttgaagctaagaatgctttccaagaaggcaacagtatctgcctggggttttcctcacagtgcaaaagcactgagcaaacagggtgatggttgtgtttggttggtttttggtttgtttgtttgattttggttttggggtctttgtttgttttttgaggcaatatctgtctatgtaggtctggctatcctggaactcacttgtagtccaggctggccccaaactcacagagttctacctgcctctgctgggattaaaggtgagttgccaccatgccccgtgagtgagcagtttttgaagacaggctgcggaaatctgtgtatacacttttttttttcacagcataacaacccaatttgtttctttaatctgaaaaaacaaaggcaacttacaggtataattatattagatactatacagcatcaacattatttatgggatataaataattgactttcccacttgttaaaagaatcctaccaaaacaaaaccaaaaagagtaggtcatttgattttctatgcctcatggttattatatagatacatttggggctctaaagtcattgttaccccgtacataatctgtaataagatgagtatgtaaaaaaaaatgtacagcctcattttctaagctcagcgcacatgagattggctcttcatagtaaaagcacatactgtgacaagcacatgtgacacaacacagacacagtcactgatactcttgacaattgccaagatgtccaggcagagccttgatttaagtgagtctggacgtatgctcagtactcagtgcgatgtagcctagcctttaacatccaaagcaggctttcttgttagaggtgtgctactggggctggggagatcactcaggaaactggttttgcctggcaagcatgaagacctgtgttcaatccccaccacctatgtaaaaagcaaggcttggtggctctggaaaggtagagagagatagacccctcaggcgcgtttcccagccagcctagcctacttggtaagttctttgccactaagagaccttgtcttaaaattcaaggtgatggtgcaaataacatgtacacacacatacacacaagcacacacgcaaatctgctaatgattaacagcagaatgagagcagtaacaagagagggcaggaatctagtcgatacaaaggcttatgcagaacatgtgaaccatctatctattcagtctgcaacaatgccagcttagctttatgccccagggcacatgagtcttcctgatctctaagtcttgaagtatgggtctcacctttatatacccaatgccccattagaacaggtattttgaaaagccttttcaacaattaattcgttttgttgttgttgttgttgtttgtttgtttgactttgatggtctgaggggtgaacctaggatttgtgggtgctaagcctgacctccactatggatggtagccccccagcctatgacagttcatcttagaataaatgggactggcaaggtcttcctggaaaaacaatgttgcaaatagcaacaatgttgcaaataacaacaatggtgcaaatagcaacaatgttgcaaatagcaacattgaaataatacagccctccctgtatttactcagtaacacacacacacacacacacacacacacacacacacacacacactaagaactgcaggggttggttggttcagtaaataagaacaatgaattgttctccaaacatgaagtcctgactttgaatcttcaacactttcattaaaaaaaaaaaaaatggctatacatactccagtattgggggcaaacataggtagattccccttttgccccccaaaactaaatcccacatggcagcatatatcatatgtgtaactcctgtattggaaacagacataggcagatcctgagtgttcatggcccagccagcctatatgaaactgcaagcccaggctcagtgagagaccctgtctcaaggcagcaaggtgcagtgctagaatgagatacgctaaggcctgctctgcagtgtgcatggaccaaccaagtgcacacacaggcacacctgtgtgtacacaccattcatgacatgcacacacaacactatggagccatactgaattcataaattcagagctgaagtgggttctggatttacattaccattaaccccttacatccagtgggaagttagagagccgtgtagggtgtgggttgctgcagtgaccctgtgtactccggcattcagtgacctggatcctcacccccactaaatggcagtcatgcctctctttgcttagtctagggactaaacaccacattccccttgggagagtagccagggctcctaatggtcaggtctgacgttccattacagctctgctgtgtgactgctcacgtgactgagcctctccagccactgtccagcctgagataatctgtatcttcgttccttgcttaaaggcagtttgagaacattttcgtggagagctctttaaaacaccttttcaatggagctgggtcttgttggagcggcgtggtcattctctgtccagatggctcaccttgcgcctaaacagtatgcccttcaaatgaataagtaataaaggcatatgatacagtgttcctgctgtgcattccccatgttccctgttctcccctacacacaccctgagctactaaaaatacctacagctctcaaaggatttcctttcattgtccatgaggcccttcccagcatagattcaaatgcttaccagaaagggcctgattttcttcaacaaaaagagtcaaaaaaaaaaaaaaaaaaaaaaagagtcaagaccagtagatacctggtcatttagttcttttacattgagaaaagaaaaaaaaaaagagttaagaatgtggatggctctgatgagagtattttcaggacacgtcagggcagttacttacacaaatggattcagacgttgagacggtcagaaggcgagacctgcacaggatctgcatcgagtgaagaggtgatcatacgtgccagccctacctcagaactttggcagttgatggctgctgcgagccagggagtcagttctctccaaagatgcggtccgcggtccagtagatggctctccaccaatgtgcacgctggcggtgctgagtggactctatggctgaaggaaaggacacaggaagttgggagggaagaatggaagagggtagaggaggaattggggatgagggagtggagtgggaactttggtcaaagcacagcgtgtgtatatatcccaaattctgaaaggcaatataggtagacaagaaacagaattttttcataccgtaaacaatatcataaaacaaaattttccagtcagggaaatttgtcagaattgtgttcttacctcagtagaatgaatagcacttagaataatgtctctctacacactagtaattttcatcattagcataatacttgtgggtgaggaggcaaccagctgtacaccttgcctgtgcaccacaggtacaggtgctaccctgagccaaacgtacattttctgaggtgtgactgtcaacagcgaggggagcttcgtttggccacaccagcaaccgctgcaccaattagctcctcggcatcaagacatttaaaaaagtagagtcaccctcttcggctaactccattttacaggggtcataaaaatcacggttcatatttgcggtgagaaatgagatatagagaaactgtccatgtcattgttgaaacagacagggcattcaataaatggaagcatacagcatgagaaccttcaatgtaatcaatgtaatcaatcaaatatcgcgagaagcttctgaagtgaattttcaaaacaatcagtccttactgcaataaaaagaccaggtgctgttaccttcctttttccataagaggaaacaacctcggtggctgtttggccacagtcacacaccttgacaccggttctgggtttcttcgatgccattcctccacttctttctagaccacgttgccagtttccacaccagcaaagtcaggaccgcttcagcctcctgacacgcccaattctcttaatgcgctcagaagcgcaattggcccattttatgaagacaactctctgtccttctgttccctgccgccattcttatcaactgtgccatccattcagaacggatttggggttgtggtcactttcgaccacttggcctgtgagcctctgtaagctaaatggttgaaactgtgggtccccaaggctcccatcaaactcccgctggcttccctccaccactacgctcagatttctttctctcttttacacttgccagacctgacccaggggacttcctcctcccttgccttcatctgcccttcagccacttgttaatccttaaagcttggttgccctctctctcccttccttatttcttcaaaatccagtctgagctgagggaagttgttttctgacaagggacagaacaccgccttgggaatgccaggcggtgcagagtcaccgtggggattaccgcgcttagacgttgttttctttggatcagtcccagaacgcgtacaaaaggatgattgtgactgtcagcagatatgacaggaaatggtctcatttcacacaattcagatgaatgtcatctgtagagaggaagccagccatttcaaaggagaaacgggggggggggggagcccgtgggttacttcttctaccctaaactcagaaggaatttgcttcactaaatggcaaaaagcgttgctcttccgataaactcatatttgcatttcccctggcaattgaataatcccttagtagttaattaactgtaaaagaagataagattgagtagctgtaggaggaggtagcttttaagtttactgctgggctgggcataatctattttatttctaatcaaaagccaagaaaccatctctaacctagcccagaggaaagtctaccttccccagcctccgtctttgatcctattgtacatcctggtgagtgctctatgaccacactaaggagacacgttggcacgtcaggggcgctaagcctttggaagtggtacccctccccatccttgatgcccaggattagctcacaaaggttcttttttttcccagctgctcctttttcatgacttgtttattgcaaatgctttcccttgctctgtgttcagaagccacgacttaaccatcctgatttgtctcctttgctctctgtctcttgcttcctgcaccagtcgagcctgttgacgcccgccccgctgctgaccgaggactgaccactcgaccaggtatctgactcgccccatttcgcctctgctctcagcactgtgcgcttcagcaaacatgcctctctgggttgcacgtgttacgggatagaatttaaaacgactgtaggcaccaagcatgatttcagagtcttggcttctccttatgcctcatttcccaagttcctacgtgatctagtgtttgtttgtttgtttgtttgtttgtttgtttctgagccttctttctgaaacaaagagagtcttttcaaatgtggggctctttttcttgatttcttccttttttaataaatgaagagtgtgatgtggaccctgtcctcacacacggtagaggcccagggaggtgtagatttcagtgggaaattgattcttgctgaagacatctccttcctctcttgtttagtattcatgggggtccttgagtggcctcagacttttgttggttactaacatagacacaatttccttaaaatatcattattggtatttctccagctccagaaatacttagtgccctctgtggattgactatgcttacgctcagccagtggctgaagtaacacaacagatggatatgcataattttgcagagaagcccttttgtttttctgtcttacaaatttcttcactatcaaaatagatatttctttttatacagtttcccaagattaaaaagaaatgggtttcgaccccctattctatgtttagcccccggctaaacttaaagtcttaagaataatgtcacaccgcaagagacatagaacccgcttgtgtctactccttgcacagcctcaccccactgatagtgaccgacaaagtgaatcagagaggggaaagtcaatgaattggaagatctgtgtattgtggagagattttcttccaaatagcacataccttcccacgtttactttctttatgcccagatcccatgagatactcaagagcaatgttaacatcccttggggacatcactaaagggaggtagttttgcttcctggttcagaggtatccccagtaagaccagatatggccacgcccctcttcttgccattcaaatctctagccttggctgctgccagccatggtcctagggaaagactttgagagtccttctggcatcacactgatcccatgatgtggttcagcacctgagcagaaattgcagagtgatacgtcggaggacagctgacctcattgatctgacgaacgtcttgtctgaagtgcttttaaaagaaccttgagttatataagttgtacactctttgggctctctcatgtcctctttaatgacagtgtcactaagtaaatgtccagggaaccagcagttgaccttcccatgctgttctgccagccagtgaagcccaaggcagggccagtaagtccagtgagtcctcaccacagctacaaccagctcaagctggtctcctagactttttaaaatagcacgctactcgttttatttttttaaagatgacctattttttatctataaacataaaatgtaatattgaggcgtacatccagccgattttattacattcctctattatataaggatgtacttgttcctgttcaaataatccagcactcacacagtcaaccagctcatcttctcactctgtttatgtaaactgaacatgtaaaaggcattttcatacactggcaaaaaaaagtcatctgttttgagaaaagaaactaatggcgttctacagaacagggaaagcctacaataacaacagtattatcccatgagacatcaatgttgtaaattctgtgaatactcaaaaagaataaatgataaggttcttgctcccgggggcctgagatgtaatcaaaaacaactcactttgaatttagagaaagatgggaggacaggaatatatgaggacacacaaagacgtttggtgacagagcatgttatccagggaactctctggaaaggagctttccacagagagaggggagtgggagatttaaggcccaggggagggcgaggaggaaatcagttagattagaaactgtcctgggcttgtccttgtaagacctgtatccatatatccacatccttccaaagatagccaccgaagaggaagatggtatacaccaggcatgcggaagccagctaagctgcaattatgagcatggaatttgctcaccgtgtctgaggagttgtgtaggctctatcatctgtacttctgtgttggcaatgagtctgccgcatattcagactgataccttcctacgctgtgcacctgttccaataactctacagccacctgttaggaatccacactctggactctgccacattgcatctgtagacttttccggtcttagatgcccttcccaggattgccctccaccattgctctttaataatctttcttgtcactcagaaacaaagaaatcaagggtgtgagttttggcttagtcctttctatgccctgtttcacatcaccatgatgaagagaatgattttctttcttatctgaaaaaccaggatattgtaacttttagaagatagtgtcacccacaagccacagcaataatgatgccgatttttagacacagtgacaatcccagctactcactcttcctggaatgtttccaagcaaaaactggactcttgcagacaataagaaaacacatcagcagtctcttcacttggtgtgttaagctaccccgccattattccctgtcccatccttctccaggcctaacaatctagtttcgtgaccccaagagatattttcctattgatttatttcattgttctattgttttgttaatctctctgtaataatattgcttagtgcgtagaacatcttctaaatgccattacgtgctgaacagcagtgaaagagggactctttctgctgagtcttacactactgaactgtgaacattgccagtcgtgctagcatgtgacgtgaatttgattttttttttttgcctttttctgtcatcagatacactgtcagtgtcctctccaccataccaggagcttatacggttttaaatggggacgtaataattgacatattcatcgcaatgctgtgctctctgcctcccccaccccctgatataaaagggaagactacttacaagttttcactaaaatctcagaagtaactttaactgccgtgttactactcgcatgtggtgagggaaggctgcattagaaagaaatcactgttgatctaacgaggaagtaggtcaggttttataaaggtttggaggaagatgaaaataagcaaccggggtgatttaaagagcattcatgtcactgccacattagaaaaaaaaatagtgtcaggaagtacagagaacagagtgagttataatatgaaaaaaataaaggtaatttttttaagtaatgtaaaaatagaaggttgcagttcttcaagtagtatccaaggacaagggctgtcgaatgaaaacaagcagagctaatgagatgaaacagaaaggggacttacaggtctcgttgtgtctttcctgtctaaattaataaaaatgatctcccgatgaaaggaaattaaagttcagatagaacaccgtgagaaaagaaagcgctaagcctttgtattcgttgcctagtcacctatcgctgtgtaacaagtagccccagaacttagcagcttcatagagcaagcgtttagctccttacagcagtttcagccagccagcattttagcatagggcagagctggctggttctggctcaggctctttcatgaaatcacaatgaagacactgccaaagctgtggtctcctgaaggtctggctagagctgacagagatcaagcactctcttggctgctgtcaggagccttcggtaccttcccatggcagctggcttcccacacaccaagaagtacaatagagggaataagaaagaagctttggtgccttttataaggcatcagttctgccatgttctacttacatagataccatatcatcccctgctccggagaacaaaagaacaaagttctggttttttgaaatcattattaataataaatgtgtgttgtatactcacatatgtagacaagtacagttccctacaacccaggctaagaacacatgaagaggaacttgaacaacagtggctagtcattgtgagagttagaacagaagagtaggaaggcccagctagaaggaaatggggaagtgtgatccagaggcagaagcgagggagagcagcattgtactgtgagcagattggcattcatcatgagcctggtttacggtgggttgtccaagggaagcgttgtgggcagttagacaagaggtggtgatgagtcacacccagcatggactgcccaggtctgtcaattatactcactctcagcagaagccatgctgactggctgacgggctttctcagtgcttatgaccttgtgcttttcagggtcagcagggggttgacaagttttccaatacttgatggacaagattggaagagccattagacccagaagaggcaatgagttcccacaggagttgcgggaattcacaatgtgtagccagagaaaggaatcctcactgccttgcctttaatgtctgacacacgtgctcaaacctacctggtgtcacagatagatgcctggctcactcgaaataggaccaggccctgcggtgtaggttacagggagaccgtgttgcagtaatctgtaggaaacaaaatcattctctctggtatgcaaactgacctctacctttgaattcacgtaggtgctaagaacctgcctccattggaaacatcatggaggaggtggctctaaaagcccttccttcatagcctcagattctacttcagtaggatcacttcagaaaacacgacaactgatgcaaacggacatcccttctgtctgtcttcacttccatttctaaaacatattttaccttttagttttgagcctcagatgaatagttgaatcatgaaacgctgtaagaattggtccaagaaccatgcagccacgtatagagaaagaggaattaggtaatgaattctattgatcccagagacgctctctgttcattgtgtgctcctttcgagtcagcggatgaagcgattccacggggcgtgttcagctagagagctgggatgctgagctaaacaaattatgtgactgacagtgctaccgccgtgcagagaaatatgaacatgatttacttgcaattagaacaaagctccaaagtaatggatttgttctcccaggtcgttaaagttcatttccaaagccgtgcatttcgtttttctttaagcagtcccagcccataaaaagtgcacacataataaacaacaagccgctaaaaccaagtcaacatttcttaggtacaatttaacctggcatcttaaccagcattgatttttcccccctttccctccctccccttttaattatggcatgtgtttggccacacaggcattacatattcagcgttcttcagtctttttgtttgctaggtggtggttaatggtttaaatctagggtgtcatttttcttgagaaaaatccctaaatccgtttttcctaaaagctctggccaagagagaactttaaggcagtttttgcctccttgtggctggcggtcacactaacggatggccctgcatactttgtgtttgacgcaggttctgggctgacaaacatcaagacggaagagatctcggaagtgaagatggatgcagaattcggacatgattcaggatttgaagtccgccatcaaaaactggtaggcaaaaataaactgcctctccccgagattgcgtctggccagatgaaatacgtggcacctcgtggcttgtcctgtgtcaaaactgagaaggactactgggaataaaaccaaaatgcctgcctagatcttcacaaagataggaaggagaggaagtggggctctgttgatagttcttgctgagcagaagccgctgagcccaggcggaacatacaagtgtaattcagtccaacgttgcagctacgtgagctgacttcctaggaaaatggttttttcgggttaaacacatctaatcccaatatccaaactggaaggcaggataccacaaacaagaaattcaagtccatgaggctctgatattactgtgtgggggaagcataagtgaatttcatttagaggtggtcccagtttccaagatggtctcattatgtaaataccaaaaaaaaaaaaaagttagaaatcaagattttcgaaacccttttggtcatgaccattctcggtccacgatagttttatttgaagaattggtcttaaataagcatgtggggagtacttggttgtagggatgctctctcgcagtgcttggttaagttctcatctacaaatggataatttcagtccattccaacccctcctccttcctactgcttccccacctcccagtatttctttggcttacaagggaaagttagcagagaccctttaaggtgagtgaagcccagcggtgactttgccgcctcagcttctcagtcagaaatcttgggcaaggcagatagcagtttctctaaagacaatggcggttttcttcctaatgtcagaattagaatgagtagagaagcacgggtcttccttataggtaggcggagattatataattctctaccaaaacctcagaaattcaaataagccaaattccagatcgttagagttccttccatgttaccagttatcacaataaaggacttgagtgggaattttaaaaacggtaagaaaatacctgtatagtggtgcttgataagaactccagctctgtggttgggtggagtgtgggagactgcagcctgattcctttgtaaagtatcttcccagtgtttgtaaataaaatgtgtagatcctagtatgaatctccaaaagaaagggcctttactgttgggcttctcaattctggattattgtagcaaatctaaagctggcttgggattcaattttgcattaatttttttttcctttttttattcagaaaaaggcacccagccttctgaaatgtagttttcgttggaaagtttattgctgttttgttattgtgaaaccagaggcactcctgagcaggctgaaactgcaaggtttcaaaacaaatctggggtaactgctgaaaggctggctgggggtcggggcgtggctcggaagatgagtacccaggatcccgttttcctgagctggtgtcatagacgcccttctcagtaattacatgaacttctataatgcgacagtgactaatgacagccgcagcaattaggggtatcagctccctctactgcactagctgataagataatgtactataattagtgcaatgaatattacagaattacagtatttccttaaagacggagggatatatccagactcacatttattcccgatcacctcactgtagtatcattagttaattaatgatctcctttaataaatgtgttgagctagcatttttggttggcgaggggattaattacgagccatttctaattttgccgcagatgcgctgtgagtaacatccacttagaaaaattttatctgctctagtttacctcgcctttgcaaactgcagcagggatggatttagcgatggaaatcggtcattcacctatcttgaagccgcctggaaagaattatttagggagctgttggcactaacttacataacaaatgtgctctagatcgttaggcacagctgcccctccctccctcgtttaacccaccatataagatcatctcttatataacaagatgattaaagtgcagtctgtatgtgttatttcgcctaagtagataaagctgggaaccactggcttgcttttcaaaagagcgtggagacgtatgtatacactgcagagactttctcaccgtgaatacatttcttctttgtcacgttctcaggattcttttttatgttcaatataaacaaccagagtaaagcaatattgccaattttggtttctaggggcaactggataaagtatgacttgtttgttacactgagattctctttgcctactgctgcttcccttggcaaacatggcgcttttaaaggagagtatgcgttctgtggttaattgaatctatgtactattgtactatgaagaaggtagcttggctgtccttttctctctgattaactcctgtgtttcagaacgttttttgacccatatagaacatgtcccttcaaagaaacggaagcatgcaggtttgaaacctagctaagggcaaagtcacctgctgtgggcaggaacggagtgacctgtttccagaacaatggcggggacctctatttggtttttaccaaatgcttacctgttaaagggcttcagatccctgcagacttctacctcatgatgcaccagagaaattgacttcagaacccgggaagccacctgttgctcattgttccagagacgaggacgctcagtcctagggacccaccaactcacgcttcgctgagctatggcggagggtcccctgaaactttgctacatccgttgcctcttgcgcttacagacctttttctcggcttcctttcgaaggtgttctttgctgaagatgtgggttcgaacaaaggcgccatcatcggactcatggtgggcggcgttgtcatagcaaccgtgattgtcatcaccctggtgatgttgaagaagaaacagtacacatccatccatcatggcgtggtggaggtaggtaaacctggaggcttgtctgcaagtgggaggcaagccaggaagtacaggcactggcccggggccacttaggagaaaagcaacatccctctgtggtactcagggcacagctgctctctcgctgttttgcatccacccctgggtgccatgaatttaatgtgctctcattaacattatgcattgttacttttaacttatgacttgtattgaaattaaccaaactaagactaattatgacgctcagctttaaaaatacatgtatggtttctcttaaataacaaaaatggtatcagaagtcaaaaaacggaacctagacgttcatttctgatttgtattttttgttgttttgtttgggcctctgattagaaccaggtgatgataaataatactgattttttttcagtaatgactcctagcattaatttctggaaggaagtggcccagtagcgaatagctcagtatagcatgcgtggttaccatggaggaacattcaggctgttgccctgaacttccacctgagcagagatcgtagtttcccggagttagtggagaagcacagggagtgtgggatgaggtacacacgagcccttcacactgcatatatgctggacttctttctgcccgcagagcagccaagcagggacgcttaccacaaaagtcagtgctacgtcatcaaaaaagtacaggactcgaatgtaactccttccccgtcttgattcggggaagaaagagtgaaaggaggtagattcacaaacatttaaatatatttgtggtgacgggaaagttttaaagcatccctgtgtgattaacttttagatatataatagtataaaccatctagaacccaaagaacgccgagtccaagcagatctcattttgtaggtgagaaaagtcgatcaaataaaaagaaccgcacagtgccaagcttaatacagtcagggtttcccccattctacccattgatttccatcagaggccagtgttaagtaagcatctaattaaacccgaagaaagtgctctaagccatccttaatcatacaaaggcagggacagtttaataaactcaagctaaagaaagccagagatctcacattcattggtccttagattctcgacacttcattcgtgaggatgctcatgggaattactgtgggttttattttcctgtcctagttgatgtggatatactaaagaccagtgtgttgggtgaggcccaggaaactgagggggcaagaggcgaaagagctgaaaatttcacacactagagtataaacatgttttgttttgtttcatttttctcaaagcaataactctggggctggagagatatccagtaaagtgtttgccacacaaatgtaaggacctgtgtttgggtctgtagcatcctcacaacacaccaggcacaacatacccgggatgccagtactggagagagacacgtgaacccaagggtttgcaggaatcgacaagctccaggttcggggagagaccctgactcaagaaataaggtggagagctttgagaaatgcctacctacatcaacctctggcctgcgcatgcacatgtccacatgcaagagcatgtgtgtgtacatgcatacacacacacacacacacacacacacacacacacacacacatgcacagataccaaatttggggttttgttctttctataatggcacctaagttttgttcttcaaggactgtaaaacattatctccaatgcatctttctctcgtttctaatgaaatctgttttccccctacttcaatcccctatttgcatatgcgaataattcaaaaactcctttgaatttcattaatagaattcaatttaaatggtcttacagtggaatgactctgtccaagctgggacttctgtctgggaggaaaataagtctgccaattcccatcttgataccacaagccagagcctgtctctgcttgctgagtctaccagcaaggtaccaaggctaccacagagagaaccacagacagagtggatggcacaacaaaagtgtactttcctgaccagtgatggaggttagaagtctgagaccaggctgtcagcagccttggttgcacctgatgcctctctccttggtttgtagatgtttgtgttctcccatggtctcccgggggtcttactatgtcctgatctcttccttctaaggacatactgggctacagtctgcccacatgacttcatttggcagtagtcattatagccacaatctgaagccttggatttgataggggcacattgatacccagtaacaacaacactgagcaacaacaacaacaaaaaaaggtgtgatgttcttaccagaactccattcacgctgagacatgggaattttctcgaaggcttcagtataacacacactaatgctgactgctttgaggtactctttaggcaggctttgggtagcaaaaaatgataccccctcacctcctaacctaagccccctcttaaacaccttcctgcaacctggaccgagtgattcttttgggcagtaaccaagagacactgcctcttcagaatgacagagggaaagaggttgacatgttgattctaaagaaacttcggcatcctggaagggtcactgctcggcgtatccaagtggcatcttcttgagcgccactcaagaaatggtcttggttttcacttgattccctatagactcactttgtcctggagagggatgccgtggagagtctgaaatctctttccctttaacagtctgtgtttctgtccgtgacgaggcttggtccagctccgtattgagtccacactgggacagagggttgaaatagaactcacttgtactgctgtgcctgtaccctgcccttggggaggtgtcatttagctggagtggtagaactaggccaccgagagctactcttcagcctggggtgtcagtattgaagcacgctgccatgggcttcagcaagcccttcatctttgagtacctcgggaatgcgcagggtggatgtcaccctctcctgcctgactttggagcgctgcacacactcggccacagtgtctccacagccacaggttgagctccccacccccgccccgccccaactgatcaaaagtatttagggaaaataatgcacctgagcatgaacagattattccataaataatcactatgacaaccatttgcatttagattgtatttggaattatatgtcacagtcatctgggggtgcgtagccatgctgtataggggagaatgtgtgtaggtcatatgcagataccatgcgttattaagcaaagaacttaagcacccttcctctttggttttggaacccatctcctgtgtgtgctgaagaaacgctgcacgtacgtggaaatgacactattcccggctctacttcatttccttcatggatgagcagacctcattcatgtcagtaagaacaaaaaggggcaacgaatggaccgagtgtcccggtcactcaaggccacgtctttgtatttttccatcacctgggcatggtggaagcatgtgtctcctgagtatctcttgtcctcacaatgaaagactcccatgggtcacaaagtagcaagcctaggaaaactgtggagggaaatgtgggcattcaaagaagcctagtggctattattattattatcatttattattatttttgatacagtaaatagccatcaggcatgagcagttggtttggattttttaaatattttttattacatattttcctcaattacatttccaatgctatcccaaaagtctcccttaccctcccccccacttccctacccacccattcccatttttttggccctggcattcccctgtactggggcatataaagtttgcaagtccaatgggcctctctttccagtgatggccgactaggccatcttttgatacacatgcagctagagtcaagagctccggggtactggatagttcataatgttgcacctacagggttgcagatctctttagctccttgggtactttctctagctcctccattgggggccctgtgatccatccaatagctgactgtgagcatccacttctgtgtttgctaggccccggcatagtctcacaagagacagctacatctgggtcctttcgataaaatcttgctagtgtatgcaatggtgtcagcgtttggaagctgattatggggtagatctctggatatggcagtctctagatggtccatcctttcgtctcagctccaaactttgtaactccttgtggtttggatttttaatacctaagaagtaaatattaatttaacgatttgcttaacatgatgccaaaggttcattctgccaggaaggcttcctactttagtaacagctatcatggcccttgagtattgcctcctgaacatgcccacaatttcagtctgttgctagaggcacacagtggtcacagagggattggcacagtcctcgaggtagctttgagggcccttgctaggaggaaggctcatccttgttctttgtttagccggaggtttctccccagacatgaatattcacttccagaattcaagacgattggggattaaaagatgccatttggactcttctcctcgggtgcctttaaaagcaatctattcggaagcccagagccctgtgaacactgagggctaagctgtccccatggcaggaatcgtgaaccccttctgcttcccagcagcaaagggcatggaggattagcacgcaaagcaaaccaagaaaagacagggaattgagatgcccggactgagtccgctctcggagccttggatctccggtggggctcccttgagcatttattttggagtttgaagtcagaaaactaaataacagtactaaacacgaaggtgctctgctgttcttggaaaatgcagaagactgttggcaggcagctcgagagccgctgcccctcctcgaggtatagacacactaagaaacagcagctacatgcttgatctccaaagcaagtttatttatttatttttttaattcccttatttgacatttcagttatggggtcctagagagtggagaaaatggccaggttcaagtggcacaggattgcagacaggcttgtctctagcaagccgaacaggagggtgactgaatgctctcactttggggagttaatctgtagagagaaggcattttagcttgcaagcctgtcgccaattaaatcgaggtgacctcatttgttgacagcagagcagatcacagcaaacaggaggagatgggaaaaacacctgtgtgtttctcccaaggggcagtgatgctgagcagtgttctctgagtgctagctcctgggtaggccttggtataagaggaaaacacccaggcccttactggagtgacctggagactggactgcaggcaactctcacaggagggaagatgcgagcagctcccatctggatcccacctcgtgcagatgggaggagtcagggcggatgagcagaaggaaatgtcccaggacctaagggcagggcagctcctattcccactgcctttgactgtgtcctgaagtctgtcctgaagtctgtctcgtgcccagcctaaaaaggactaactagttctctgaagtggggtcacacccaatggccatgaaggaattcatctctacaaggctctccacctgaattactccttaggtgggactaggcgtgatctgtgtgtatcatatgatctatgtgtatcataccacatgtctgtccatcacctggtaggtagggcagcactggcaccatgcatatctgccccccccttgttgttttaggagccaccataacagtaagacagttgtgcagggtctgaactgtgccacactggcagtaggcggggtgggggcaggggacagagacaaagagaaagctggggaattgccagacatcatttgacagtgctcagcaatgggaactagagacctctgaaaaatgaggctgcaagctccattcagtccaggacagaataagaaatatccctgtgaaatgaatcccatagaacacaccttaacttttctgtgggaaacatggtttatgctatgtgcatacggacagagtcctctcgtcttccaacgcggctttacagaggcttggagctcatattaatccagcagactcaagcaagcacctcctcttctcctcactgggagaggtaggacaaatatagaaacaagaaaagccattagctactgtagagagatgtgtgccccgcacagtctgcagagactaacacctgcccggctctccgtgacaatggctgaggcagattatgtttaccgtgccgacctgatcttacagctgaagcctgctgtagagctctggcctggcggaaatgaggcctgaatgcaacccccaggactacaaatcctgtatgtgtaggatgaatgggtaggtgggtggatggatggatgagtggatggaaggatggatcgacagacagacagatatgtatgtatgtatgtatgtatgtatgtatgtatgtatgtataattaggatagtgtgtctatacagtttccctttttgtgtcaagtaataccccccttttttcaaatttttattagataattttttcatttacacttcaaatgctatcccaaaagtcccctataccctacccctggtaatacaccttttatatacatacactcacacacacacagacacacacatacatccatatatgttacctttatttataccccttttatatgtgtatgtgtgtatatatatacatatatatatatatatatatgtatatatataataaaagacatatacatacatgtgtgtgtgtgtgtgtatcttttatttaataggctctcaaaactctcattaacatttctacagagataaatgtacttcgaaatggcagcagatacctggggccccacaaagcggagtgttatattctgcacagatctaagcgtcactcacagtcattcacagtgcggctttgtgagatgttctttctccttcaccatcccacaaactccagtgctggctgtttcagccaatgtgccctgtgcagacccgagtactcgcctcaagaatttcagcaccacctagtggccagatgcagcatcggcgtaagccattggctctgccacgtggtgtcagaagttggggctaaagctgataaatcacggttgttaagtactttgggggcaaagaaaagaactgcacaccgtgtcctgttactgcctacgagtactgtgctcctttaaagtcctcggtctattttaaacccggatctctgtacctgctttctaggtcgacgccgccgtgaccccagaggagcgccatctctccaagatgcagcagaacggatatgagaatccaacttacaagttctttgagcaaatgcagaactaagccccacccgcgccacagcagcggcctctgaacttggacagcgaaaccattgcttcactacccatcggtgttcatttataaaataacgtggaaagaaacaaacccttccgtttatttactcaccctcggcttttgacagctgtgctgtaacacaagtagatgcctgaacttgaattaatatacaaatcagtaatgtattctcgctttctctctttacattctggtctctacattacatgattcatgggttttgtgtactgtaaaaaaaaaaattagctgtatcaaactagtgcatgaatagattctctcctaattatttatcacatacatagccccttagcccgttgtatattattcttgtggtttgtggcccggaaaaaactcctacttgaaatatgctttaaaaatcgatgggggatgcttcttgtgaacgtgggcgtctagctgcttctcctacgtattcttttcctgatcactatgcattttgaacatttttttaagtattccaaatgacttagaaaattctttttccatgactgcatcttactgtacagattgctgcttctgctctctttgtgatataggaataagaggatacacattgatttctttgtgcctgttttatgtgcacacattaggcattgagaatttgaacattttttttgtccatgtatctttggatctttgataaaaaaaaattaaaaaaaaattatccctgttcatcataagcacttttacgggtggggggagggagtgttctgctggtctccaattaccaagaattctccaaaaattaattttctgcaggatgattgtacagaatcattgcttatgccatgatagctttctacactgtattacataaataaattaaataaaataactccaggcaagacgtttctttgaagggtgattgtgtgggagggaaaaggcaagatccctgcatttatcaacccaaggcgcttcgtttaataatactgacagagaatgaaaagccaggaagagagtaagagggaagagagggcaccctgagacacccctgagggtttgtataaaattgtgttttcataggaataccttagactggtatgattgtatggtgagagtttattgcttagtcatctagacccgtgagaacacctcatctggtcactcacacctaacctgtgagtctgatgaggaaattgtgggcgcacacagctcttagtgctggtaaactaactggtggagtttgttgtttttaaaaggctgtgcttccctggcttggttcttcctttctgtcttagtcagggtttgtattcctgcacaaaacatcatggccaagaagcaagttggggaggaaagggtttattcagcttacacttccacattgctcttttgtttatcaccaaaggaagtcaggacaggaactcacacagggcaggaacttggaggcaggagctgatgcagaggccatggaggatgctgcttactggcttgcttcccctggcttgctcagtttgctttcttatagaacccaagactaccagtccagggatggcaccacccacaatgggccctccccccttgatcacaataattgagaaaatgccttacagctagatcgcatggaggcatttccttgagggaggctcctttctctatgataactccagcttgtgtcaagttgacacacaaaaactaacaggttccaaatgtgaaacacacacacacacacacacacacacaaacaaaacaaaaacagagaaaagctgtagagttttgatttgggggttttgttttttgttttgttttgttttgttttgtttttcgctttcaagctagggtctcaagtatcccaatctaacctttaactcatgtagccaaagatggccttatcctcctgatggtcctgcctctaccttgcaaatattgggactgcagcatgcgccatcgtgccctgtgtatatgaagtgctgggatttgacttcaaggctccctgtatgctaagtaagttctctaccaagtgagctacatccccaggccctggaaatgatgggtagagcagctgatagtctgcagcaagctctggacctgggcactccccacatttttgggggagtcactcttattcgtggggatacgaacgttctaggatatttaaccgcatccgcctgattctaaccagaaatgtctcccgagctgtatgatgtctcacacgcctgtgactccagtgcttgggagggaagcaagagaccaggcctgcctggaaaacagggtgagatcctgtctcaaagagtgagaagcagaagtgtttccagaagacgttctccaacaccagaagacggatcaagtgtccagatcctgccaaacatctcttacggaagcgagttacaaaccactgatctataaacagtattttgacctttatattatgtggcatgtgttgtatatgatacaatgaacgtgcgtttgagtttcaaaggactactggctgggaagtgtgtgccttccactctgtgtggtctggaatcagactcaagtcatcaggcttggcagcaagtacttttacccactgagccttcctaccatccttcattttagcttaatggcctgtgcacacaaccttttattgaggatgcttgtattaattccagctgctataagaataaacaatagacaaagactaaatgtctaaacttcacatttttctattctatcagggaagaagattgtgatggccgtgtttgggttctagaagagacttcttcctagcttgcacctgaccgactcctcacatgatggtgagggaagtctctagtgcttcatcttccttgggtgttaaccccatcttgagacctgacctgacctagccctaggcacttcccaaacatcccatctctacatgtcatcattgagaactggggtttcaatgtaaatttaaatccagctgctcttccaaatgtcagggagcacattgttcctcctttattgtcctgtatctcaagaacgtagggatcagccaaacacttgtaccatgtgctagagtcatggtggcacacagcttgtgggagtaaccagccaataactgatttgatttaaggccctctccacagggtgtaagagaccagatagccttgggacctaggggaagaacaaataataatggtcttttaaaaagaacaaaaaagtgataatgaatcagccaagcaccttttagctttacatcacaatattttaaacgatgtttcagtataccactatagtatggacaaactgggtggaaacacctgagggttaaatttttcacagaagaattaggtgtgactacaccgaaaacacaggacaaattgtgagaataagatattatcattttgcctggcctagtgagaggtgataggataattctaagacatttacatctagtacatttctactgatgtcaacgaaattgaaagctgactcccatacatagttatgtatgacacttaaagtccaggccagccttcagttgtagtgaccgtaagttttagtttaattttttaatttttccccaaggaggtaagatttgaaagtgtggtgtgactttcccacaggagacataagcaaacatctatcccagagagatcatcaagaacaaagaaataattttcctgaagtctaacggcaaacattgtgtttattgggattaccacgggggaaatggatggagcactagttacagaggcatggttgactcaagagtagctatatcaccaaaaggcccacctctgaggaaagatgcaaccagctctctgcaggctcctctctccccaacagtgtgctcgtataaccttgagaaggaagggggacttgttgatattgtttcaggagctttcctagattggtggtcatttggctcctgagtctaaagaagtctcctggacagaatgatcttgataaagaacacactagcactcatcagggtgctaggacagggactttggtgtggttagcagggtgaatgacacagggtatctaagaagagcttagtttgtatttatccccagtgacgttgagactttcttgtgctcaaaggctattttacagttcaaaatttcaatttatatcttttgtattcagacttaatgtctatattagtatccacttggcaactcttctgtgtcacatttctacttgcagagtaggtttttgtctacagtcttagggttttaaggctgtgaacagataccatgaccatggcaactcttataaggacaacatttaatgggacctggcttaaaggttcagaggttcataaaggtgggaacatggcagcatccaggaaggcatggtacaggaggagctgaaa

SEQ ID NO: 3 - DNA, 22 bp, Artificial sequence
  Primer
ccagccaacacagaaaacgaag

SEQ ID NO: 4 - DNA, 25 bp, Artificial sequence
  Primer
ctagttctgcatctgctcaaagaac

SEQ ID NO: 5 - DNA, 18 bp, Artificial sequence
  Primer
agacggaagagatctcgg

SEQ ID NO: 6 - DNA, 18 bp, Artificial sequence
  Primer
ggtcacggcggcgtcgac

SEQ ID NO: 7 - DNA, 18 bp, Artificial sequence
  Synthetic oligonucleotide
caccttgaaaacaaatta

SEQ ID NO: 8 - DNA, 18 bp, Artificial sequence
  Synthetic oligonucleotide
aagaacaccttgaaaaca

SEQ ID NO: 9 - DNA, 18 bp, Artificial sequence
  Synthetic oligonucleotide
ctgcaaagaacaccttga

SEQ ID NO: 10 - DNA, 18 bp, Artificial sequence
  Synthetic oligonucleotide
atcttctgcaaagaacac

SEQ ID NO: 11 - DNA, 18 bp, Artificial sequence
  Synthetic oligonucleotide
cccacatcttctgcaaag

SEQ ID NO: 12 - DNA, 18 bp, Artificial sequence
  Synthetic oligonucleotide
ttgaacccacatcttctg

SEQ ID NO: 13 - DNA, 18 bp, Artificial sequence
  Synthetic oligonucleotide
tttgtttgaacccacatc

SEQ ID NO: 14 - DNA, 18 bp, Artificial sequence
  Synthetic oligonucleotide
gcacctttgtttgaaccc

SEQ ID NO: 15 - DNA, 18 bp, Artificial sequence
  Synthetic oligonucleotide
tgattgcacctttgtttg

SEQ ID NO: 16 - DNA, 18 bp, Artificial sequence
  Synthetic oligonucleotide
tccaatgattgcaccttt

SEQ ID NO: 17 - DNA, 18 bp, Artificial sequence
  Synthetic oligonucleotide
atgagtccaatgattgca

SEQ ID NO: 18 - DNA, 18 bp, Artificial sequence
  Synthetic oligonucleotide
ccaccatgagtccaatga

SEQ ID NO: 19 - DNA, 18 bp, Artificial sequence
  Synthetic oligonucleotide
accgcccaccatgagtcc

SEQ ID NO: 20 - DNA, 18 bp, Artificial sequence
  Synthetic oligonucleotide
acaacaccgcccaccatg

SEQ ID NO: 21 - DNA, 18 bp, Artificial sequence
  Synthetic oligonucleotide
ctatgacaacaccgccca

SEQ ID NO: 22 - DNA, 18 bp, Artificial sequence
  Synthetic oligonucleotide
tgtcgctatgacaacacc

SEQ ID NO: 23 - DNA, 18 bp, Artificial sequence
  Synthetic oligonucleotide
atcactgtcgctatgaca

SEQ ID NO: 24 - DNA, 18 bp, Artificial sequence
  Synthetic oligonucleotide
tgacgatcactgtcgcta

SEQ ID NO: 25 - DNA, 18 bp, Artificial sequence
  Synthetic oligonucleotide
ggtgatgacgatcactgt

SEQ ID NO: 26 - DNA, 18 bp, Artificial sequence
  Synthetic oligonucleotide
accaaggtgatgacgatc

SEQ ID NO: 27 - DNA, 18 bp, Artificial sequence
  Synthetic oligonucleotide
gcatcaccaaggtgatga

SEQ ID NO: 28 - DNA, 18 bp, Artificial sequence
  Synthetic oligonucleotide
cttcagcatcaccaaggt

SEQ ID NO: 29 - DNA, 18 bp, Artificial sequence
  Synthetic oligonucleotide
ttcttcttcagcatcacc

SEQ ID NO: 30 - DNA, 18 bp, Artificial sequence
  Synthetic oligonucleotide
actgtttcttcttcagca

SEQ ID NO: 31 - DNA, 18 bp, Artificial sequence
  Synthetic oligonucleotide
tgtgtactgtttcttctt

SEQ ID NO: 32 - DNA, 18 bp, Artificial sequence
  Synthetic oligonucleotide
atggatgtgtactgtttc

SEQ ID NO: 33 - DNA, 18 bp, Artificial sequence
  Synthetic oligonucleotide
gatgaatggatgtgtact

SEQ ID NO: 34 - DNA, 18 bp, Artificial sequence
  Synthetic oligonucleotide
accatgatgaatggatgt

SEQ ID NO: 35 - DNA, 18 bp, Artificial sequence
  Synthetic oligonucleotide
accacaccatgatgaatg

SEQ ID NO: 36 - DNA, 18 bp, Artificial sequence
  Synthetic oligonucleotide
cctccaccacaccatgat

SEQ ID NO: 37 - DNA, 18 bp, Artificial sequence
  Synthetic oligonucleotide
acctacctccaccacacc

SEQ ID NO: 38 - DNA, 18 bp, Artificial sequence
  Synthetic oligonucleotide
agtttacctacctccacc

SEQ ID NO: 39 - DNA, 18 bp, Artificial sequence
  Synthetic oligonucleotide
agtcaagtttacctacct

SEQ ID NO: 40 - DNA, 18 bp, Artificial sequence
  Synthetic oligonucleotide
catgcagtcaagtttacc

SEQ ID NO: 41 - DNA, 18 bp, Artificial sequence
  Synthetic oligonucleotide
ggaaacatgcagtcaagt

SEQ ID NO: 42 - DNA, 18 bp, Artificial sequence
  Synthetic oligonucleotide
cacttggaaacatgcagt

SEQ ID NO: 43 - DNA, 18 bp, Artificial sequence
  Synthetic oligonucleotide
caccttcgaaaggaagcc

SEQ ID NO: 44 - DNA, 18 bp, Artificial sequence
  Synthetic oligonucleotide
aagaacaccttcgaaagg

SEQ ID NO: 45 - DNA, 18 bp, Artificial sequence
  Synthetic oligonucleotide
cagcaaagaacaccttcg

SEQ ID NO: 46 - DNA, 18 bp, Artificial sequence
  Synthetic oligonucleotide
atcttcagcaaagaacac

SEQ ID NO: 47 - DNA, 18 bp, Artificial sequence
  Synthetic oligonucleotide
cccacatcttcagcaaag

SEQ ID NO: 48 - DNA, 18 bp, Artificial sequence
  Synthetic oligonucleotide
tcgaacccacatcttcag

SEQ ID NO: 49 - DNA, 18 bp, Artificial sequence
  Synthetic oligonucleotide
tttgttcgaacccacatc

SEQ ID NO: 50 - DNA, 18 bp, Artificial sequence
  Synthetic oligonucleotide
gcgcctttgttcgaaccc

SEQ ID NO: 51 - DNA, 18 bp, Artificial sequence
  Synthetic oligonucleotide
tgatggcgcctttgttcg

SEQ ID NO: 52 - DNA, 18 bp, Artificial sequence
  Synthetic oligonucleotide
tccgatgatggcgccttt

SEQ ID NO: 53 - DNA, 18 bp, Artificial sequence
  Synthetic oligonucleotide
atgagtccgatgatggcg

SEQ ID NO: 54 - DNA, 18 bp, Artificial sequence
  Synthetic oligonucleotide
ccaccatgagtccgatga

SEQ ID NO: 55 - DNA, 18 bp, Artificial sequence
  Synthetic oligonucleotide
gccgcccaccatgagtcc

SEQ ID NO: 56 - DNA, 18 bp, Artificial sequence
  Synthetic oligonucleotide
acaacgccgcccaccatg

SEQ ID NO: 57 - DNA, 18 bp, Artificial sequence
  Synthetic oligonucleotide
ctatgacaacgccgccca

SEQ ID NO: 58 - DNA, 18 bp, Artificial sequence
  Synthetic oligonucleotide
ggttgctatgacaacgcc

SEQ ID NO: 59 - DNA, 18 bp, Artificial sequence
  Synthetic oligonucleotide
atcacggttgctatgaca

SEQ ID NO: 60 - DNA, 18 bp, Artificial sequence
  Synthetic oligonucleotide
tgacaatcacggttgcta

SEQ ID NO: 61 - DNA, 18 bp, Artificial sequence
  Synthetic oligonucleotide
ggtgatgacaatcacggt

SEQ ID NO: 62 - DNA, 18 bp, Artificial sequence
  Synthetic oligonucleotide
accagggtgatgacaatc

SEQ ID NO: 63 - DNA, 18 bp, Artificial sequence
  Synthetic oligonucleotide
acatcaccagggtgatga

SEQ ID NO: 64 - DNA, 18 bp, Artificial sequence
  Synthetic oligonucleotide
cttcaacatcaccagggt

SEQ ID NO: 65 - DNA, 18 bp, Artificial sequence
  Synthetic oligonucleotide
ttcttcttcaacatcacc

SEQ ID NO: 66 - DNA, 18 bp, Artificial sequence
  Synthetic oligonucleotide
actgtttcttcttcaaca

SEQ ID NO: 67 - DNA, 18 bp, Artificial sequence
  Synthetic oligonucleotide
gatggatggatgtgtact

SEQ ID NO: 68 - DNA, 18 bp, Artificial sequence
  Synthetic oligonucleotide
gccatgatggatggatgt

SEQ ID NO: 69 - DNA, 18 bp, Artificial sequence
  Synthetic oligonucleotide
accacgccatgatggatg

SEQ ID NO: 70 - DNA, 18 bp, Artificial sequence
  Synthetic oligonucleotide
cctccaccacgccatgat

SEQ ID NO: 71 - DNA, 18 bp, Artificial sequence
  Synthetic oligonucleotide
acctacctccaccacgcc

SEQ ID NO: 72 - DNA, 18 bp, Artificial sequence
  Synthetic oligonucleotide
ggtttacctacctccacc

SEQ ID NO: 73 - DNA, 18 bp, Artificial sequence
  Synthetic oligonucleotide
ctccaggtttacctacct

SEQ ID NO: 74 - DNA, 18 bp, Artificial sequence
  Synthetic oligonucleotide
caagcctccaggtttacc

SEQ ID NO: 75 - DNA, 18 bp, Artificial sequence
  Synthetic oligonucleotide
gcagacaagcctccaggt

SEQ ID NO: 76 - DNA, 18 bp, Artificial sequence
  Synthetic oligonucleotide
ttagtttaatcacgctcg

SEQ ID NO: 77 - DNA, 20 bp, Artificial sequence
  Primer
aaagacctgtacgccaacac

SEQ ID NO: 78 - DNA, 21 bp, Artificial sequence
  Primer
gtcatactcctgcttgctgat

The invention claimed is:

1. A modified oligonucleotide consisting of 16 to 19 linked nucleosides, wherein the nucleobase sequence of the modified oligonucleotide is 100% complementary to an equal-length portion within nucleobase 282128 and nucleobase 282150 of SEQ ID NO: 1, wherein the modified oligonucleotide comprises at least one modification selected from a modified sugar moiety and a modified internucleoside linkage.

2. A modified oligonucleotide consisting of 18 to 21 linked nucleosides, wherein the modified oligonucleotide comprises a nucleobase sequence selected from SEQ ID NOs: 7-10, 13, 14, 16, 19-21, 23, 24, 27, 28, 30-32, and 34-42, and wherein the modified oligonucleotide comprises at least one modification selected from a modified sugar moiety and a modified internucleoside linkage.

3. The modified oligonucleotide of claim 2, wherein the nucleobase sequence of the modified oligonucleotide consists of the nucleobase sequence of SEQ ID NO: 9, SEQ ID NO: 10, or SEQ ID NO: 39.

4. The modified oligonucleotide of claim 2, wherein the nucleobase sequence of the modified oligonucleotide is at least 90% or is 100% complementary to an equal-length region of SEQ ID NO: 1, as measured over the entire length of the modified oligonucleotide.

5. The modified oligonucleotide of claim 2, consisting of a single-stranded modified oligonucleotide.

6. The modified oligonucleotide of claim 2, wherein the modified oligonucleotide comprises at least one modified nucleoside.

7. The modified oligonucleotide of claim 6, wherein at least one modified nucleoside comprises a modified sugar moiety.

8. The modified oligonucleotide of claim 7, wherein at least one modified sugar moiety is a 2'-substituted sugar moiety.

9. The modified oligonucleotide of claim 8, wherein the 2'-substitutent of at least one 2'-substituted sugar moiety is selected from among: 2'-OMe, 2'-F, and 2'-O-methoxyethyl.

10. The modified oligonucleotide of claim 7, wherein at least one modified sugar moiety is a bicyclic sugar moiety.

11. The modified oligonucleotide of claim 10, wherein at least one bicyclic sugar moiety is LNA or cEt.

12. The modified oligonucleotide of claim 7, wherein at least one sugar moiety is a sugar surrogate.

13. The modified oligonucleotide of claim 12, wherein at least one sugar surrogate is a morpholino or a modified morpholino.

14. The modified oligonucleotide of claim 2, wherein the modified oligonucleotide comprises at least 5, at least 10, at least 15, at least 16, at least 17, or 18 modified nucleosides, each independently comprising a modified sugar moiety.

15. The modified oligonucleotide of claim 2, wherein the modified oligonucleotide comprises at least one modified internucleoside linkage.

16. The modified oligonucleotide of claim 15, wherein each internucleoside linkage is a modified internucleoside linkage.

17. The modified oligonucleotide of claim 15, comprising at least one phosphorothioate internucleoside linkage.

18. A pharmaceutical composition comprising a modified oligonucleotide according to claim 2, and a pharmaceutically acceptable carrier or diluent.

19. A method of modulating splicing of an APP transcript in a cell comprising contacting the cell with a modified oligonucleotide according to claim 2.

20. The method of claim 19, wherein inclusion of exon 17 in the APP transcript is reduced.

21. A method of decreasing expression of amyloid β in a cell, comprising contacting the cell with a modified oligonucleotide according to claim 2.

22. The modified oligonucleotide of claim 1, wherein the modified oligonucleotide consists of 18 linked nucleosides, wherein each internucleoside linkage is a modified internucleoside linkage and each of the nucleosides comprises a 2'-O-methoxyethyl substituted sugar moiety.

23. The modified oligonucleotide of claim 1, consisting of a single-stranded modified oligonucleotide.

24. The modified oligonucleotide of claim 1, wherein the modified oligonucleotide comprises at least one modified nucleoside.

25. The modified oligonucleotide of claim 24, wherein at least one modified nucleoside comprises a modified sugar moiety.

26. The modified oligonucleotide of claim 25, wherein at least one modified sugar moiety is a 2'-substituted sugar moiety.

27. The modified oligonucleotide of claim 26, wherein the 2'-substitutent of at least one 2'-substituted sugar moiety is selected from among: 2'-OMe, 2'-F, and 2'-O-methoxyethyl.

28. The modified oligonucleotide of claim 25, wherein at least one modified sugar moiety is a bicyclic sugar moiety.

29. The modified oligonucleotide of claim 28, wherein at least one bicyclic sugar moiety is LNA or cEt.

30. The modified oligonucleotide of claim 25, wherein at least one sugar moiety is a sugar surrogate.

31. The modified oligonucleotide of claim 30, wherein at least one sugar surrogate is a morpholino or a modified morpholino.

32. The modified oligonucleotide of claim 1, wherein the modified oligonucleotide comprises at least 5, at least 10, at least 15, at least 16, at least 17, or 18 modified nucleosides, each independently comprising a modified sugar moiety.

33. The modified oligonucleotide of claim 1, wherein the modified oligonucleotide comprises at least one modified internucleoside linkage.

34. The modified oligonucleotide of claim 33, wherein each internucleoside linkage is a modified internucleoside linkage.

35. The modified oligonucleotide of claim 33, comprising at least one phosphorothioate internucleoside linkage.

36. A pharmaceutical composition comprising a modified oligonucleotide according to claim 1, and a pharmaceutically acceptable carrier or diluent.

37. A method of modulating splicing of an APP transcript in a cell comprising contacting the cell with a modified oligonucleotide according to claim 1.

38. The method of claim 37, wherein inclusion of exon 17 in the APP transcript is reduced.

39. A method of decreasing expression of amyloid β in a cell, comprising contacting the cell with a modified oligonucleotide according to claim 1.

* * * * *